US009745359B2

(12) United States Patent
Qin

(10) Patent No.: US 9,745,359 B2
(45) Date of Patent: Aug. 29, 2017

(54) PROTEIN AND PROTEIN CONJUGATE FOR DIABETES TREATMENT, AND APPLICATIONS THEREOF

(71) Applicant: ADDA Biotech Inc., Beijing (CN)

(72) Inventor: Shulin Qin, Beijing (CN)

(73) Assignee: ADDA Biotech Inc. (CN)

( * ) Notice: Subject to any disclaimer, the term of this patent is extended or adjusted under 35 U.S.C. 154(b) by 0 days.

(21) Appl. No.: 14/402,074

(22) PCT Filed: May 17, 2013

(86) PCT No.: PCT/CN2013/000587
§ 371 (c)(1),
(2) Date: Nov. 18, 2014

(87) PCT Pub. No.: WO2013/170636
PCT Pub. Date: Nov. 21, 2013

(65) Prior Publication Data
US 2015/0183847 A1 Jul. 2, 2015

(30) Foreign Application Priority Data
May 18, 2012 (CN) .......................... 2012 1 0157196

(51) Int. Cl.
| A61K 36/26 | (2006.01) |
| C07K 14/545 | (2006.01) |
| C07K 14/605 | (2006.01) |
| C07K 14/575 | (2006.01) |
| C07K 14/62 | (2006.01) |
| C07K 14/645 | (2006.01) |
| A61K 38/00 | (2006.01) |

(52) U.S. Cl.
CPC .......... *C07K 14/545* (2013.01); *C07K 14/575* (2013.01); *C07K 14/605* (2013.01); *C07K 14/62* (2013.01); *C07K 14/645* (2013.01); *A61K 38/00* (2013.01); *C07K 2319/00* (2013.01); *C07K 2319/31* (2013.01); *C07K 2319/74* (2013.01)

(58) Field of Classification Search
CPC ..... C07K 14/575; C07K 14/645; A61K 38/26
See application file for complete search history.

(56) References Cited

U.S. PATENT DOCUMENTS

| 5,075,222 | A | 12/1991 | Hannum et al. |
| 6,096,728 | A | 8/2000 | Collins et al. |
| 6,399,573 | B1 | 6/2002 | Young |
| 6,541,623 | B1 | 4/2003 | Ford et al. |
| 7,141,547 | B2 | 11/2006 | Rosen et al. |
| 7,235,627 | B2 | 6/2007 | Knudson et al. |
| 2001/0047084 | A1 | 11/2001 | Knudsen et al. |
| 2009/0286722 | A1 | 11/2009 | Flatt et al. |
| 2011/0312881 | A1* | 12/2011 | Silverman ............ C07K 19/00 514/4.8 |

FOREIGN PATENT DOCUMENTS

| CN | 101220088 A | 7/2008 |
| CN | 101889022 A | 11/2010 |
| WO | 9108285 A1 | 6/1991 |
| WO | 9117184 A1 | 11/1991 |
| WO | 0248192 A2 | 6/2002 |
| WO | 03103572 A2 | 12/2003 |
| WO | 2004093823 A2 | 11/2004 |
| WO | 2008101017 A2 | 8/2008 |
| WO | 2009058734 A1 | 5/2009 |
| WO | 2009155258 A2 | 12/2009 |
| WO | 2011073328 A1 | 6/2011 |
| WO | 2011075393 A2 | 6/2011 |
| WO | 2011084808 A2 | 7/2011 |
| WO | 2013002580 A2 | 1/2013 |

OTHER PUBLICATIONS

Ardestani et al., "Neutralizing Interleukin-1β (IL-1β) Induces β-Cell Survival by Maintaining PDX1 Protein Nuclear Localization", The Journal of Biological Chemistry vol. 286, No. 19, pp. 17144-17155, May 13, 2011.
Arend, William P., "Interleukin-1 Peceptor Antagonist Discovery, Structure and Properties", Progress in Growth Factor Research, vol. 2, pp. 193-205, 1990.
Bendtzen et al., "Cytotoxicity of Human pl 7 Interleukin-1 for Pancreatic Islets of Langerhans", Science, vol. 232, No. 4757, Jun. 1986, pp. 1545-1547.
Braddock et al., "Targeting IL-1 in Inflammatory Disease: New Opportunities for Therapeutic Intervention", Nature Reivews, Drug History, vol. 3, Apr. 2004, pp. 1-10.
Böni-Schnetzler et al., "Increased Interleukin (IL)-1β Messenger Ribonucleic Acid Expression in β-Cells of Individuals with Type 2 Diabetes and Regulation of IL-1β in Human Islets by Glucose and Autostimulation", Endocrine Research, J Clin Endocrinol Metab, Oct. 2008, 93(10):4065-4074.
Carstensen et al., "Accelerated Increase in Serum Interleukin-1 Receptor Antagonist Statrs 6 Years before Diagnosis of Type 2 Diabetes", Diabetes, vol. 59, May 2010, pp. 1222-1227.
Chia et al., "Role and development of GLP-1 receptor agonists in the management of diabetes", Diabetes, Metabolic Syndrome and Obesity: Targets and Therapy, 2009, pp. 37-49, Dovepress.
Donath et al., "Islet Inflammation in Type 2 Diabetes: From metabolic stress to therapy", Diabetes Care, vol. 31, Supplement 2, Feb. 2008. pp. S161-S164.

(Continued)

*Primary Examiner* — Gyan Chandra
(74) *Attorney, Agent, or Firm* — Lerner, David, Littenberg, Krumholz & Mentlik, LLP

(57) ABSTRACT

The present invention relates to the field of biopharmaceutics, and in particular to a protein, a protein conjugate, a pharmaceutical composition and its use for treating diabetes. The fusion protein of the present invention is obtained by linking two polypeptides, wherein one polypeptide is an interleukin-1 receptor antagonistic protein or an analog thereof, and another polypeptide is GLP-1 receptor binding polypeptide or an analog thereof, or an insulin receptor binding polypeptide or an analog thereof, or a GIP receptor binding polypeptide or an analog thereof. The fusion proteins of the present invention and conjugates thereof have a significant efficacy in treating diabetes, and can be used in a lower dose, resulting in a marked reduction in side effects.

12 Claims, 6 Drawing Sheets

(56) References Cited

OTHER PUBLICATIONS

Donath et al., "Mechanisms of β-Cell Death in Type 2 Diabetes", Diabetes, vol. 54, Supplement 2, Dec. 2005, pp. S108-S113.
Donath et al., "Type 2 diabetes as an inflammatory disease", Nature Reviews, Immunology, vol. 11, Feb. 2011, pp. 98-107.
Ehses et al., "IL-1 antagonism reduces hyperglycemia and tissue inflammation in the type 2 diabetic GK rat", PNAS, vol. 106, No. 33, Aug. 18, 2009, pp. 13998-14003.
Eisenberg et al., "Interleukin 1 receptor antagonist is a member of the interleukin 1 gene family: Evolution of a cytokine control mechanism", Proc. Natl. Acad. Sci. USA, vol. 88, pp. 5232-5236, Jun. 1991.
Eisenberg et al., "Primary structure and functional expression from complementary DNA of a Human interleukin-1 receptor antagonist", Nature, vol. 343, Jan. 25, 1990, pp. 341-346.
Gault et al., "Effects of the novel (Pro3)GIP antagonist and exendin(9-39)amide on GIP- and GLP-1-induced cyclic AMP generation, insulin secretion and postprandial insulin release in obese diabetic (ob/ob) mice: evidence that GIP is the major physiological incretin", Diabetologia, 2003, 46:222-230.
Gelling et al., "GIP6-30amide contains the high affinity binding region of GIP and is a potent inhibitor of GIP1-42 action in vitro", Regulatory Peptides, 69 (1997) pp. 151-154.
International Search Report and Written Opinion for Application No. PCT/CN2013/000587 dated Aug. 22, 2013.
Irwin et al., "Therapeutic potential for GIP receptor agonists and antagonists", Best Practice & Research Clinical Endocrinology & Metabolism, 23 (2009) pp. 499-512.
Jagannathan-Bogdan et al., "Elevated Proinflammatory Cytokine Production by a Skewed T Cell Compartment Requires Monocytes and Promotes Inflammation in Type 2 Diabetes", The Journal of Immunology, copyright 2011, 15 pages.
Kim et al., "Glucose-dependent Insulinotropic Polypeptide (GIP) Stimulation of Pancreatic β-Cell Survival Is Dependent upon Phosphatidylinositol 3-Kinase (PI3K)/Protein Kinase B (PKB) Signaling, Inactivation of the Forkhead Transcription Factor Foxo1, and Down-regulation of bax Expression*", The Journal of Biological Chemistry, vol. 280, No. 23, Issue of Jun. 10, pp. 22297-22307, 2005.
Larsen et al., "Interleukin-1-Receptor Antagonist in Type 2 Diabetes Mellitus", The New England Journal of Medicine, 2007; 356, pp. 1517-1526.
Larsen et al., "Sustained Effects of Interleukin-1 Receptor Antagonist Treatment in Type 2 Diabetes", Emerging Treatments and Technologies, Diabetes Care, vol. 32, No. 9, Sep. 2009, pp. 1663-1668.
Liu Zbongcheng et al. Cloning, Expression and Identification of IL-Ira-Fce Fusion Gene. Chinese Journal of Biotechnology, Oct. 25, 2008, vol. 24. No. 10, pp. 1754-1760.
M., Shenqi , Accession No. AEZ5J 871, HSA-GGGGS-IL-1 Ra fusion protein, partial [synthetic construct], GenDank, Feb. 7, 2012, <http://www.ncbi.nlm.nih.gov/protein/AEZ51871>.
McClean et al., "GIP receptor antagonism reverses obesity, insulin resistance, and associated metabolic disturbances induced in mice by prolonged consumption of high-fat diet", Am J Physiol Endocrinol Metab, 293: pp. E1746-E1755, 2007.
Morisset, Sophie et al. IL- Ira/IGF-1 Gene Therapy Modulates Repair of Microfractured Chondral Defects. Clinical Orthopaedics and Related Research. Sep. 2007, No. 462, pp. 221-228.
O'Harte et al., "Antagonistic effects of two novel GIP analogs, (Hyp3)GIP and (Hyp3)GIPLys16PAL, on the biological actions of GIP and longer-term effects in diabetic ob/ob mice", Am J Physiol Endocrinol Metab, 292, pp. E1674-E1682, 2007.
Pan et al., "Design of a Long Acting Peptide Functioning as Both a Glucagon-like Peptide-1 Receptor Agonist and a Glucagon Receptor Antagonist", The Journal of Biological Chemistry, vol. 281, No. 18, pp. 12506-12515, May 5, 2006.
Pfleger et al., "Association of IL-1ra and Adiponectin With C-Peptide and Remission in Patients With Type 1 Diabetes", Diabetes, vol. 57, Apr. 2008, pp. 929-937.
Tseng et al., "Postprandial Stimulation of Insulin Release by Glucose-dependent Insulinotropic Polypeptide (GIP)", Rapid Publication, J. Clin. Invest., vol. 98, No. 11, Dec. 1996, pp. 2440-2445.
Widenmaier et al., "A GIP Receptor Agonist Exhibits β-Cell Anti-Apoptotic Actions in Rat Models of Diabetes Resulting in Improved β-Cell Function and Glycemic Control", PLoS ONE, vol. 5, Issue 3, Mar. 2010, pp. 1-10.
Extended European Search Report for Application No. 13791642.5 dated Sep. 16, 2015.

* cited by examiner

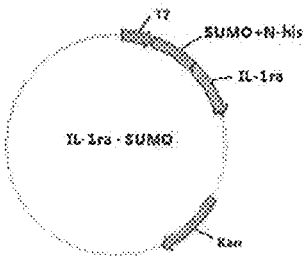
Figure 1A
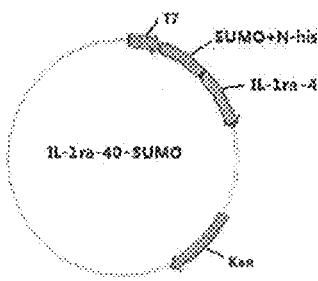
Figure 1B
Figure 2

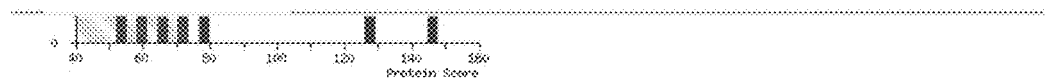

Concise Protein Summary Report

[Format As] Concise Protein Summary ▼     Help

Significance threshold p< 0.05     Max. number of hits 5

[Re Search All]   [Search Unmatched]

1. gi|27894321   Mass: 16360   Score: 146   Expect: 2.9e-09   Matches: 12
   interleukin-1 receptor antagonist protein isoform 4 [Homo sapiens]
   gi|114677861   Mass: 16390   Score: 146   Expect: 2.9e-09   Matches: 12
   PREDICTED: interleukin-1 receptor antagonist protein isoform 2 [Pan troglodytes]
   gi|1640243   Mass: 17244   Score: 132   Expect: 7.1e-08   Matches: 12
   Chain A, Initial Crystallographic Analyses Of A Recombinant Interleukin-1 Receptor Antagonist Protein
   gi|157831486   Mass: 17475   Score: 129   Expect: 1.4e-07   Matches: 12
   Chain A, Solution Structure Of Human Interleukin-1 Receptor Antagonist Protein
   gi|118833147   Mass: 18182   Score: 128   Expect: 1.8e-07   Matches: 12
   interleukin-1 receptor antagonist protein isoform 3 [Homo sapiens]
   gi|155600894   Mass: 19178   Score: 128   Expect: 1.8e-07   Matches: 12
   PREDICTED: interleukin-1 receptor antagonist protein isoform 4 [Pan troglodytes]
   gi|27894312   Mass: 20170   Score: 125   Expect: 3.6e-07   Matches: 12

Figure 6A

Protein sequence coverage: 55%

Matched peptides shown in *bold red*.

```
  1 RPSGRKSSKM QAFRIWDVNQ KTFYLRNNQL VAGYLQGPNV NLEEKIDVVP
 51 IEPHALFLGI HGGKMCLSCV KSGDETRLQL EAVNITDLSE NRKQDKRFAF
101 IRSDSGPTTS FESAACPGWF LCTAMEADQP VSLTNMPDEG VMVTKFYFQE
151 DE    (SEQ ID NO:218)
```

Unformatted sequence string: 152 residues (for pasting into other applications).

[Sort peptides by]   ● Residue Number   ○ Increasing Mass   ○ Decreasing Mass

[Show predicted peptides also]

| Start - End | Observed | Mr(expt) | Mr(calc) | Delta M | Peptide |
|---|---|---|---|---|---|
| 19 - 28 | 1835.7800 | 1834.7727 | 1834.7715 | 0.0013 1 | K.QAFRIWDVNQK.T (SEQ ID NO:515) |
| 19 - 28 | 1851.7900 | 1850.7827 | 1850.7664 | 0.0164 1 | K.MQAFRIWDVNQK.T + Oxidation (M) (SEQ ID NO:515) |

Figure 6B

PROTEIN AND PROTEIN CONJUGATE FOR DIABETES TREATMENT, AND APPLICATIONS THEREOF

CROSS-REFERENCE TO RELATED APPLICATIONS

The present application is a national phase entry under 35 U.S.C. §371 of International Application No. PCT/CN2013/000587 filed May 17, 2013, published in Chinese, which claims priority from Chinese patent application 201210157196.6 filed May 18, 2012, all of which are incorporated herein by reference.

SEQUENCE LISTING

The instant application contains a Sequence Listing which has been submitted electronically in ASCII format and is hereby incorporated by reference in its entirety. Said ASCII copy, created on Mar. 31, 2015, is named 9BOSS3.3F-002 (E)_SL.txt and is 1,095,257 bytes in size.

TECHNICAL FIELD

The invention belongs to the field of biopharmaceutics, and relates to a protein, a protein conjugate and the use thereof for treating diabetes.

BACKGROUND ART

Cytokines are biologically active macromolecules present in or released from cells. Most of them are polypeptide-like species, such as interleukins, interferons, colony-stimulating factor (CSF), and tumor necrosis factor (TNF). They are not expressed or expressed in a low amount in normal body, but are transcribed and translated in abnormal states (disease or infection). Cytokines regulate or modulate cellular responses in inflammatory or immune responses. They activate biological responses by binding to the specific receptors on the surfaces of the sensitive cells. Since cytokines often have their receptors on various target cells, pleiotropic effects of the responses are common features for a cytokine. A second messenger can also be generated through other cytokines or cytokine receptors.

For a highly active cytokine, there must be a mechanism by which its release is controlled and its activities are constrained. The biosynthesis and release of a cytokine can be regulated strictly by other cytokines or exogenous factors. Two mechanisms for controlling the activities of a cytokine have been found: the first is a receptor antagonist (inhibitory protein type I) which has a structure homologous to that of the cytokine and can bind to the receptor molecule, but does not trigger signal transduction, thus exerting inhibition by competing with the cytokine; the second is a soluble receptor molecule (inhibitory protein type II) which competes with the cellular receptor for cytokine binding, thus exerting inhibition. A large amount of experiments have shown that the two suppressive responses have a physiological correlation. At present, it has been believed that inhibitor type II has a neutralizing effect similar to that of a buffer solution, which in turn limits the systemic effect of a cytokine. Meanwhile, it also allows the cytokine to rise locally to a high concentration, thereby enhancing a paracrine effect. Their recombinant forms have pharmacological activities.

Interleukin 1 (IL-1) is involved in a wide variety of physiological processes. By inducing secretion of the neutral proteases and other cytokines (tumor necrosis factor TNF), IL-1 stimulates proliferation of various hematopoietic cells and other cells, regulates pro-inflammatory responses, and mediates damage to tissues in an inflammation, including stimulating proliferation of the synoviocytes and the chondrocytes and production of PGE2, collagenase, phospholipase A, etc, inducing inflammation in a joint; facilitates release of neutrophils from the bone marrow, induces chemotaxis and infiltration of mononuclear cells and the multinucleated granulocytes into an inflammatory site, releases lysosomal enzymes locally, causes de-granulation of the basophils and the mast cells, releases inflammatory mediators, etc. IL-1 can impose damage directly on β cells which produce insulin in the pancreatic islet. The diseases associated with IL-1 comprise rheumatoid arthritis, diabetes mellitus, systemic lupus erythematosus, dermatosclerosis and other immune diseases.

IL-1 includes two relevant factors: IL-1α and IL-1β. Furthermore, there is a relevant polypeptide known as IL-1 receptor antagonist (IL-1Ra). Both IL-1α and IL-1β exert their biological activities by binding to IL-1 receptor (IL-1R) on the cellular surface and signaling into the interior of a cell via a signal transduction system. Two types of IL-1R have been found: type I receptor (IL-1RI) and type II receptor (IL-1R II). The type I receptor, also known as T-cell receptor, has a signal transduction function; whereas the type II receptor, also known as B-cell receptor, can bind to IL-1, but does not transduce the signal. In fact, IL-1RII acts as an attenuator of IL-1, which can be designated as a "trapping" receptor. When IL-1 binds to IL-1R I, a complex is formed and then binds to a IL-1R accessory protein (IL-1R AcP) with a high affinity. The IL-1 signal transduction is activated probably by a heterodimer formed by association of the intracellular portion of the IL-1R I with the IL-1R-AcP. Furthermore, the extracellular portions of the IL-1R are also known as the soluble receptors, that is, type I soluble receptor (sIL-1RI) and type II soluble receptor (sIL-1RII), which exist in the circulation system of the body both in the normal state and in the diseased cases and can bind to IL-1α, IL-1β, or IL-1Ra to act as a natural "buffer".

Arend, et al. ("Interleukin 1 receptor antagonist: A new member of the interleukin 1 family." J Clin Invest, 1991, 88(5): 1445-1451) has found a substance present in the cell culture supernatant and the body fluid and having an activity of inhibiting IL-1 and designated it as IL-1Ra. Eisenberg, et al. ("Interleukin 1 receptor antagonist is a member of the interleukin 1 gene family: evolution of a cytokine control mechanism." PNAS, 1991, 88(12): 5 232-5236) has found by molecular clone technology that the gene for IL-1Ra is 1.8 kb in length, having an open reading frame encoding 177 of amino acids; and the mature form of the IL-1Ra protein has 152 of amino acids and also has a leader sequence of 25 amino acids in length. IL-1Ra has 26%-30% homology with IL-1β, and 19% with IL-1α, with a gene structure similar to that of IL-1. Therefore, it can be postulated that the portion in which the IL-1Ra shares structural similarity with the IL-1 performs a receptor-binding function, but does not activate signal transduction across the membrane. In a pathologic state, macrophages in many tissues such as synovium and dermal tissues can produce IL-1Ra. Both the human's normal skin and the cultured keratinocytes and monocytes express IL-1Ra mRNA. Although IL-1Ra has no agonism in itself upon binding to IL-1 receptor, it can eliminate or alleviate the biological effects of the IL-1, thereby affecting pathophysiological processes in the body. The equilibrium between IL-1 and IL-1Ra determines the role of IL-1 in an inflammatory process.

Many experiments have demonstrated that IL-1Ra exerts various effects, such as suppressing generation of prostaglandins, inducing a NO concentration in the serum, reducing the amount of the expressed cyclooxygenase-2 and collagenase-1, preventing the leucocytes from infiltration and the proteoglycans in joint cartilage from degradation, antagonizing an effect of IL-1β that promote the expression of the nerve growth factor, etc., which implies a wide prospect for the use of IL-1Ra in treating inflammatory diseases such as rheumatoid arthritis, amyloidosis, osteoarthritis, allergic encephalomyelitis, etc. IL-1Ra can also improve nephritis, dermatitis and respiratory inflammation, decrease the mortality of the septic shock, increase survival rate of the heat shock, suppress growth of the myeloma, and increase the success rate of the corneal homotransplantation. Likely, some agents which can induce expression of the IL-1Ra, including the human blood serum IgA, corticosteroids, non-steroid anti-inflammatory drugs such as mofezolac, IL-4, IL-1β, IFN, TGF-β, IL-6, and other cytokines performing signal transduction through gp130, are useful in treating diseases caused by IL-1.

The trade name of IL-1Ra is Kineret. Kineret (generic name: Anakinra), which has been developed by Amgen, USA, is a non-glycosylated recombinant human IL-1Ra (rhIL-1Ra) having a molecular weight of 17.3 KD and consisting of 153 amino acids. The major difference between Kineret and the endogenous human IL-1Ra is that the former has one methionine residue at its N-terminus. On Nov. 14, 2001, Kineret was approved by FDA for marketing to treat adults with moderately to severely active rheumatoid arthritis who have had an absence of clinical improvement of symptoms in therapy with one or more disease-modifying anti-rheumatic drugs (DMARDs), so as to alleviate their symptoms. European Medicines Agency (EMA) has approved Kineret on Nov. 21, 2001 to be used in combination with methotrexate in patients who are not responsive adequately to treatment with methotrexate alone. At present, Kineret is under clinical trials for inflammatory bowel disease (IBD), asthma, and transplant rejection.

The onset of diabetes is associated with the impaired function of pancreatic islet β cells, and the function of pancreatic islet β cells will deteriorate progressively as pathological state extends. Currently it had been discovered that, in type 1 diabetes resulting from the destruction and the impaired functions of β cells caused by inflammation of pancreatic islet β cells, the pro-inflammatory factor IL-1β plays a key role in suppressing the functions of pancreatic islet β cells and facilitating apoptosis thereof. In patients with type 2 diabetes, it has been observed also that the expression of IL-1 in the pancreatic islet β cells is enhanced while the expression of IL-1Ra is reduced. Insufficiency of IL-1Ra appears to be a genetic property, since the genetic polymorphisms of the gene encoding IL-1Ra and the altered content of the serum IL-1Ra are correlated. IL-1β can improve the expression of the inflammatory cytokines in pancreatic islet, increase infiltration of the immune cells, leading to inflammation in the tissue, and affect the functions of β cells and the insulin sensitivity. In in vitro studies, the long-term exposure to high concentrations of glucose and a peptide hormone leptin secreted by adipose tissues would induce β cells and the pancreatic islet to produce and release IL-1β, which in turn causes the impaired functions and apoptosis of the β cells. Exogenous addition of an IL-1 receptor antagonist, such as IL-1Ra, can protect the β cells from the damage caused by high concentrations of glucose and leptin, and reduce the inflammatory marker of patients with type 2 diabetes. Similar studies also demonstrated that inflammatory mediator generated within the pancreatic islet is closely-related to diabetes (Boni-Schnetzler, et al, "Increased Interleukin (IL)-1β Messenger Ribonucleic Acid Expression in β-Cells of Individuals with Type 2 Diabetes and Regulation of IL-1β in Human Islets by Glucose and Autostimulation." J Clin Endocrinol Metab, 2008, 93(10): 4065-4074; Donath, et al, "Islet Inflammation Impairs the Pancreatic β-Cell in Type 2 Diabetes." Physiology (Bethesda) 2009, 24:325-331).

In one study (Ehses et al, "IL-1 antagonism reduces hyperglycemia and tissue inflammation in the type 2 diabetic GK rat", PNAS, 2009, 106(33): 13998-14003), researchers had investigated intensively the effects of IL-1 on generation of inflammatory cytokines in pancreatic islet and inflammation in peripheral tissues responsive to insulin. GK rats, which are spontaneous, nonobese model of type 2 diabetes and develop inflammation in the pancreatic islet and the insulin resistance in peripheral tissues (liver, skeletal muscles, and adipose tissues), were chose by the researchers as the object of study. It had been found that IL-1β is expressed highly in the pancreatic islet and hepatic tissues of GK rats and that in vitro administration of IL-1Ra to the rats can block specifically the activity of IL-1 and reduce the release of inflammatory cytokines from the pancreatic islet. It was also shown in in vivo experiments that IL-1Ra can improve hyperglycemia, the function of β cells and the insulin resistance in GK rats. In addition, IL-1Ra can reduce the levels of the pancreatic islet-derived pro-inflammatory cytokines, such as, IL-1β, IL-6, TNF α, KC, MCP-1, and MIP-1α and infiltration of CD68(+), MHC II(+), and CD53 (+) immune cells into the pancreatic islet. Expression of the cytokines in hepatic tissues is also reduced. Therefore, it was concluded that IL-1Ra could improve the function of β cells and may be used in treatment of type 2 diabetes.

Marc Y. Donath et al from the University of Zurich, Switzerland, conducted a double-blind clinical trial with anakinra, and it was discovered from the results that blockage of IL-1 can improve patient's hyperglycemia and functions of pancreatic islet β cells, and lower inflammatory markers in the blood. Furthermore, Marc Y. Donath et al also performed another double-blind clinical trail with an anti-IL-1 antibody XOMA 052 to evaluate its safety and pharmacokinetics. Patients in the trail showed excellent tolerance and no severe drug-related adverse reactions were reported.

In one study, 70 patients suffering from type 2 diabetes with $A_1C > 7.5\%$ and $BMI > 27$ $kg/m^2$ were randomly assigned to undergo treatment with anakinra or placebo for 13 weeks. Thirty-nine weeks after anakinra withdrawal, it had been shown that blockage of IL-1 with anakinra can lead to improvement of the proinsulin-to-insulin (PI/I) ratio and systemic inflammatory markers compared with values in placebo-treated patients, and the improvement can last 39 weeks after treatment withdrawal (Larsen et al, "Sustained Effects of Interleukin-1 Receptor Antagonist Treatment in Type 2 Diabetes", Diabetes Care 2009, 32: 1663-1668).

Collectively, the inflammatory cytokines are one of important causes for onset of diabetes. In addition to the conventional treatments currently used, the anti-inflammatory treatment is likely to be a novel approach of diabetic treatment.

Since IL-1 in a trace amount can exert a full biological effect, the biological effect of IL-1 can be efficaciously suppressed when the concentration of IL-1ra is usually more than 100-folds higher than that of IL-1. During the course of treating rheumatoid arthritis, the dosage of anakinra is up to 100-150 mg/d, which imposes a very high requirement on the downstream processing and manufacturing in biopharmaceuticals and is a challenge to the biopharmaceutical corporations. In theory, IL-1Ra can act on IL-1 receptors at any sites in the body with no selectivity. And it is a question whether administration of a large dosage for a long time would lead to increased infection in the patients due to immunosuppression. In particular the patients with diabetes are susceptible to infection and uneasy to be cured. Frequent dosing adds the burdens on the body, mind and economy of patients. Furthermore, IL-1Ra has an in vivo half-time of only 4-6 hours, which curtails the efficacy and increases the dosage. Consequently, the trend of new drug development is to design a novel, targeted IL-1ra, improve the efficacy in diabetic treatment, reduce unnecessary immunosuppression, reduce the dosage, and extend the in vivo time of action.

SUMMARY OF THE INVENTION

An object of the invention is to provide a novel therapeutic medicament for diabetes, the medicament comprises a fusion protein or a conjugate thereof.

In one aspect, the present invention provides a fusion protein consisting of two polypeptides which are linked together, wherein one polypeptide is an interleukin-1 receptor antagonistic protein or analogues thereof and the other polypeptide is a GLP-1 receptor binding polypeptide or analogues thereof, or a GIP receptor binding polypeptide or analogues thereof, or an insulin receptor binding polypeptide or analogues thereof.

The structure of said fusion protein is as follows: the interleukin-1 receptor antagonistic protein or an analogue thereof -$L_j$- the other polypeptide, or the other polypeptide -$L_j$- the interleukin-1 receptor antagonistic protein or an analogue thereof.

The sequence of said interleukin-1 receptor antagonistic protein or an analogue thereof is (SEQ ID NO: 204)
$X_{IL0}$RPSGRKSSKMQAFRIWDVNQKTFYLRNNQLVAGYLQGPNVNLEEKI

DVVPIEPHALFLGIHGGKMX$_{IL66}$LSX$_{IL69}$VKSGDETRLQLEAVX$_{IL84}$

ITDLSENRKQDKRFAFIRSDSGPTTSFESAAX$_{IL116}$PGWFLX$_{IL122}$TA

MEADQPVSLTNMPDEGVMVTKEYFQEDE, wherein $X_{IL0}$ is a methionine, cysteine, general formula 1, general formula 2 or absent;

$X_{IL66}$, $X_{IL69}$, $X_{IL116}$, or $X_{IL122}$ is a cysteine or serine; $X_{IL84}$ is a cysteine or asparagine;

$L_j$ is a linking group or spacer group, including a long chain fatty acid, polyethylene glycol, an amino acid, a short peptide, a protein, or a long chain formed by linking one or more of the optional long chain fatty acids, polyethylene glycol, amino acids, short peptides, etc through a covalent bond, or any of the structures connecting two proteins/polypeptides through a covalent bond, or absent; preferably, said linking group or spacer group comprises one or more lysines or cysteines of which the amino or mercapto groups on the side chains are available for reacting with a modifying group; preferably, the general formula of said short peptide is a (SEQ ID NO: 436)
(GlyGlyGlyGlySer)$_n$, wherein n is a 0, 1, 2, 3, 4, 5, or 6.

In one aspect, the present invention provides a protein conjugate which is a compound obtained through modifications such as acylation, grafting and the like on the basis of the fusion protein of the present invention.

In one aspect, the present invention provides a pharmaceutical composition comprising the fusion protein or the protein conjugate of the present invention and pharmaceutically acceptable carriers or additives.

In one aspect, the present invention provides the use of the fusion protein, the protein conjugate, or the pharmaceutical composition in treating diabetes.

In one aspect, the present invention provides the use of the fusion protein and the protein conjugate in preparing a medicament for treating diabetes.

In one aspect, the present invention provides a method of treating diabetes, the method comprising administering to a patient in need the fusion protein, the protein conjugate, or the pharmaceutical composition of the present invention.

The fusion protein and a derivative thereof has a significant efficacy in treating diabetes, and can be used at a lower dose, resulting in a marked reduction in side effects.

BRIEF DESCRIPTION OF THE DRAWINGS

FIG. 1A and FIG. 1B are the structures of expression vectors for the native interleukin-1 receptor antagonistic protein (IL-1Ra) (IL-1ra-40-SUMO in the figure) and the G-20 (IL-1ra-SUMO in the figure) respectively.

FIG. 2 shows the DNA sequencing results of the native interleukin-1 receptor antagonistic protein (IL-1Ra) (IL-1ra-40 in the figure) and the G-20 (IL-1ra in the figure).

FIG. 3A: a protein molecular weight marker is in the first lane, representing 9 K, 14 K, 22 K, 30 K, and 41 K respectively from the bottom; the cell lysate is in the second lane; the washing buffer through the column is in the third lane; the elution buffer through the column is in the fourth lane.

FIG. 3B: the fusion protein G-20 having the SUMO tag purified twice is in the first and second lanes, respectively; a protein molecular weight marker is in the third lane.

FIG. 3C: a protein molecular weight marker is in the first lane, a fusion protein G-20 having the SUMO tag removed is in the second lane.

FIGS. 6A and 6B are the peptide mass fingerprinting for the native interleukin-1 receptor antagonist prepared by the method for protein expression in the present invention, the protein is used as a control in the animal test.

MODE OF CARRYING OUT THE INVENTION

Definition and Terms

Figure 3A:
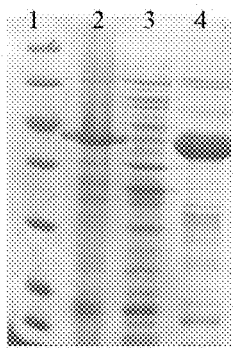
FIG. 3A-3C are the electrophoregrams of the fusion protein G-20 having the SUMO tag preliminarily purified by affinity chromatography.
Figure 3B:
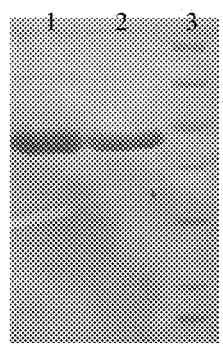
Figure 3C:
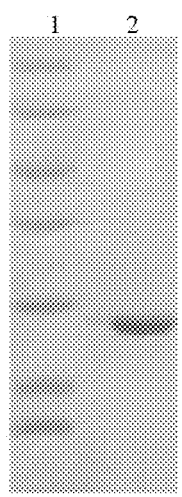

The following definitions will apply throughout the invention unless otherwise indicated. Terms not defined herein have the meaning commonly understood in the art to which the term pertains.

In this application, a hIL-1Ra or IL-1Ra denotes the mature form of a human interleukin-1 receptor antagonist, while a IL-1ra refers to its analogues, including the interleukin-1 receptor antagonists and conjugates thereof provided in the present invention.

An "amino acid" encompasses any molecule containing both amino and carboxyl functional groups, wherein the amino and carboxyl groups are attached to the same carbon atom (the alpha carbon) in alpha-amino acid. The alpha carbon may have one or two organic substituents. An amino acid encompasses the L and D isomers and a racemic mixture. Unless otherwise specified, the amino acid residues in the sequence of the polypeptide of the present invention are all L isomers, that is, L-amino acids. And a D-amino acid is indicated by prefixing the designation of the amino acid or its abbreviation with the letter "d", e.g., dK.

The expression "an encodable amino acid" or "an encodable amino acid residue" is used to indicate an amino acid or amino acid residue which could be encoded by a triplet ("codon") of nucleotides, wherein hGlu is homoglutamic acid.

α-hGlu is the L isomer of —HNCH(CO—)CH$_2$CH$_2$CH$_2$COOH.

δ-hGlu is the L isomer of —HNCH(COOH)CH$_2$CH$_2$CH$_2$CO—.

α-Asp is the L isomer of —HNCH(CO—)CH$_2$COOH.

β-Asp is the L isomer of —HNCH(COOH)CH$_2$CO—.

α-Glu is the L isomer of —HNCH(CO—)CH$_2$CH$_2$COOH.

γ-Glu is the L isomer of —HNCH(COOH)CH$_2$CH$_2$CO—.

β-Ala is —NH—CH$_2$—CH$_2$—COOH.

Sar is sarcosine.

An amino acid residue can be described with single-letter abbreviation or three-letter abbreviation.

TABLE 1

Amino Acids and abbreviations

| Amino acid | Three-letter abbreviation | Single-letter abbreviation | Amino acid | Three-letter abbreviation | Single-letter abbreviation |
|---|---|---|---|---|---|
| Glycine | Gly | G | Threonine | Thr | T |
| Alanine | Ala | A | Cysteine | Cys | C |
| Valine | Val | V | Methionine | Met | M |
| Leucine | Leu | L | Asparagine | Asn | N |
| Isoleucine | Ile | I | Glutamine | Gln | Q |
| Proline | Pro | P | Tryptophan | Trp | W |
| Phenylalanine | Phe | F | Serine | Ser | S |
| Tyrosine | Tyr | Y | Lysine | Lys | K |
| Aspartic acid | Asp | D | Arginine | Arg | R |
| Glutamic acid | Glu | E | Histidine | His | H |

Context Related to Insulin:

"Native insulin" means mammalian insulin (e.g., human insulin, bovine insulin, porcine insulin etc.) from natural, synthetic, or genetically engineered sources. Human insulin comprises an A-chain of 21 amino acids and a B-chain of 30 amino acids. The two chains are linked by three disulfide bonds formed between A7 and B7, between A20 and B19, and between A6 and A11. B7 and A7 indicate the amino acid residues at position 7 of the B chain (starting from the N-terminus) and at position 7 of the A chain (starting from the N-terminus) of native human insulin. Amino acid residues at other positions are denoted in a similar way.

"Insulin analogue" is a generic term of a modified insulin polypeptide, comprising a molecule of two chains consisting of an A chain and a B chain, as well as a single-chain insulin analogue, that retains high sequence homology with native insulin. "Insulin analogue" exhibits some, all or enhanced activity relative to a corresponding native insulin or is converted in vivo or in vitro into a polypeptide exhibiting some, all or enhanced activity relative to a corresponding native insulin, e.g., a polypeptide having the structure of a native insulin with one or more amino acid additions, deletions or substitutions. Proinsulins, pre-proinsulins, insulin precursors, single chain insulin precursors of humans, animals, even non-mammalian animals and analogues of any of the foregoing are also referred to herein as insulin analogues. Many insulin analogues are known in the art. Unless otherwise specified, the term "insulin analogue" herein is used broadly to include native insulin and insulin analogues.

An "insulin receptor binding polypeptide" includes insulin analogues, insulin derivatives as well as insulin conjugates, and other polypeptides which bind insulin receptor, including insulin like growth factor-1 (IGF-1), insulin like growth factor-2 (IGF-2) and their analogues, derivatives and conjugates.

Amino acids in the present application are indicated with the positions in the A chain or the B chain, unless otherwise specified. For example, A14, B28, etc. all indicate an amino acid residue or a variety thereof at the corresponding position in the A chain or the B chain of the insulin, wherein the numbering in the A chain or the B chain of the insulin starts from the first position at the N-terminus.

When an amino acid residue is individually referred to, as an example, it can be expressed as A1G, B1G, or B9H, meaning that the first amino acid in the A chain, the first amino acid in the B chain, and the ninth amino acid in the B chain is G, G, and H, respectively.

The numbering in the single-chain insulin compounds is specified in the description for the individual compounds.

A single chain insulin compound refers to a polypeptide sequence or a modified polypeptide sequence with the general structure of B chain-$C_L$-A chain, where the B chain is the B chain of insulin or an analogue thereof, the A chain is the A chain of insulin or an analogue thereof, and $C_L$ is a peptidic segment connecting the C-terminus of the B chain to the N-terminus of the A chain.

GLP-1, GLP-1 Analogue and GLP-1 Receptor Binding Polypeptide:

Proglucagon includes two types of glucagon-like peptides, namely GLP-1 and GLP-2. GLP-1 is mainly secreted by Langerhans cells of the terminal jejunum, ileum and colon, existing primarily in two forms: GLP-1 (7-37) and GLP-1 (7-36)-$NH_2$. GLP-1 (7-36)-$NH_2$ is a native form of the GLP-1 in the human body, which among the GLP-1 peptides, has the strongest effect of promoting secretion of insulin.

The sequence of the GLP-1 (7-36)-$NH_2$ is (SEQ ID NO: 205)
HAEGTFTSDVSSYLEGQAAKEFIAWLVKGR-$NH_2$;

the sequence of the GLP-1 (7-37) is (SEQ ID NO: 206)
HAEGTFTSDVSSYLEGQAAKEFIAWLVKGRG.

The in vivo expression and activities of GLP-1 are regulated tightly. After alanine at the second position of the N-terminus is hydrolyzed by a dipeptidyl peptidase (DPP-IV), an inactive GLP-1 (9-36)-$NH_2$ is formed, which is a natural antagonist against GLP-1R in vivo. In the body, several metabolic products of GLP-1 after enzyme cleavage include GLP-1 (9-36), GLP-1 (7-35), and GLP-1 (7-34). GLP-1 (9-36)-$NH_2$ is the major catabolic product of GLP-1 and can reach an in vivo concentration that may be higher than that of GLP-1 (7-36)-$NH_2$ by 10 times. The in vivo half-time of GLP-1 lasts for less than 5 min with a metabolic rate of 12-13 min. In physiological state, the intact GLP-1 is excreted primarily by the kidney and excluded with the aid of tissues other than the kidney.

GLP-1 are capable of facilitating insulin secretion, and the facilitating effect is glucose-dependent, the higher the blood glucose, the stronger the effect. GLP-1 binds to its receptor on the cellular membrane of the β cells in pancreatic islet and facilitates the insulin secretion by increasing intracellular cAMP, phosphorylating $K^+$-ATPase, causing the $K^+$ channels to be shut down, depolarization of cellular membrane, opening of $Ca^{2+}$ channels, influx of $Ca^{2+}$, thus stimulating the insulin secretion from cells. Such an effect is versatile, affecting various function aspects, such as transcription, translation, splicing, etc. of the pro-insulin gene.

In addition, GLP-1 can also up-regulate the genes in β cells closely associated with glycol metabolism (such as glucokinase and glucose transporter-2). However, the promoter of the insulin gene can be activated partially in a PKA-independent manner.

GLP-1 can also stimulate proliferation of the β cells in pancreatic islet and suppress apoptosis thereof. It has been found in studies that GLP-1 can stimulate neogenesis of the β cells in a non-STZ rat model and improve self-stabilization of the blood glucose in adult rats. In a neonatal GK rat, the constant status of blood glucose was significantly improved, the insulin level was raised, and the volume of β cells was enlarged after injection with GLP-1 or Exendin-4 for 5 days. With continuous administration of the above-mentioned medicament, the number of β cells in the rats are increased steadily, and the blood glucose controlling capability is significantly increased upon adult. It was found in in vitro culture that GLP-1 can induce differentiation of a mouse myoblast line and embryonic stem cells into the insulin-expressing cells. In a Zucker rat model of diabetes where the proportion of β cells undergoing apoptosis is up to more than 20%, treatment with GLP-1 can reduce the proportion of the apoptotic cell significantly. It has been found in studies that GLP-1 can suppress the streptozocin (STZ)-induced apoptosis of 3 cells in mice, while the 3 cells in the mice having the GLP-1R gene knocked out are significantly sensitive to the STZ-induced apoptosis.

In regulation of the blood glucose, the effect of glucagon is contrary to that of insulin in that the former increases the concentration of blood glucose by promoting glycogenolysis. It has been shown in both the healthy and patients with type 1 diabetes and type 2 diabetes that GLP-1 can suppress the release of glucagon, although the degree of suppression in the healthy is less than that in patients with diabetes. Injection of GLP-1 into a C-peptide-negative canine can decrease the plasma level of glucagon, suggesting that suppression of GLP-1 on glucagon is at least partially insulin-independent.

In a series of studies with murine, porcine and human, it was found that GLP-1 can suppress peristalsis of the gastrointestinal tract and secretion of stomach fluid and delay gastric emptying. In human being, administration of GLP-1 in both the healthy and patients with diabetes can result in temporary satiety and decreased appetite.

GLP-1 receptor (GLP-1R) is a G protein-coupled receptor with seven trans-membrane domains using cAMP as the major second messenger. It belongs to the subfamily of glucagon receptors under the B family of G protein-coupled receptors (the secretin family), of which family the most noted characteristic is an extracellular N-terminal sequence which is relatively longer and forms a spherical domain through 3 disulfide bonds. The human GLP-1 receptor has a homology of 90% with the corresponding murine receptor. The anatomic evidences demonstrate that cells with GLP-1R can be found in each of the segments of the intestinal tract in the murine, porcine and human, the distribution densities thereof vary among different species and genera, and the rule for distribution thereof is identical, that is, distribution densities of the cells with GLP-1R progressively increase from the proximal end to distal end of small intestine and the large intestine.

The amino acid sequence of the proglucagon 72-117 is referred to Bell, et al., Nature 304 368-371 (1983). The proglucagon fragment 72-108 is typically designated as GLP-1 (1-37). GLP-1 (7-20) is an insulinotropic GLP-1 analogue with the shortest length as far as known.

"GLP-1 analogue" is defined as the one in which one or more of amino acid residues of GLP-1 (1-37) are deleted or substituted with other amino acid residues, or the one of which one or more of amino acid residues are inserted into the original polypeptide sequence. In a preferred embodiment, total number of amino acid residues that are different between the GLP-1 analogues and the corresponding GLP-1 (1-37) is not more than 20, or not more than 15, 10, 5, 4, 3, and 2, and most preferably is 1. GLP-1 analogues may be truncated fragments of GLP-1 (1-37). GLP-1 analogues may also be sequences obtained by extending from the N- or C-terminus of GLP-1. In certain embodiments, GLP-1 analogues comprise an extension of 1-20 of amino acids at the C-terminus. In one embodiment, the sequence extending from the C-terminus is a PSSGAPPPS-NH$_2$ (SEQ ID NO:438) or GPSSGAPPPS-NH$_2$(SEQ ID NO:437). In one embodiment, C-terminal extension comprises 1-6 of positively charged amino acids, such as arginine, lysine. In one embodiment, C-terminal extension comprises 1-6 of negatively charged amino acids, such as glutamic acid, aspartic acid. In certain embodiments, the GLP-1 analogues may be a modified product, such as a product subjected to alkyl substitution, acylation, polyethylene glycol modification, etc.

Different GLP-1s have different biological activities. Capability for GLP-1 (7-36)-NH$_2$ to stimulate accumulation of [$^{14}$C]-amidopyrine is higher than those of GLP-1 (1-37) and GLP-1 (1-36)-NH$_2$ by 100 times; GLP-1 (7-36)-NH$_2$ and GLP-1 (7-37)-NH$_2$ have comparable activities and effects. GLP-1 (9-36)-NH$_2$ has no effect on the β cells and even acts as an antagonist against the adenylate cyclase in some studies; while it is apparent that GLP-1 (7-35)-OH and GLP-1 (7-34)-OH are agonists. Capability for GLP-1 (7-35)-OH or GLP-1 (7-37)-OH to raise the insulin level in plasma is lower than that of GLP-1 (7-36)-NH$_2$.

The part in GLP-1 (7-36)-NH$_2$ which binds to the receptor is primarily the amino acid residues 7-21, although the full length sequence can play a concerted role in binding to the receptor. In addition to the skeleton of the long amino acid chain, the side chains on the amino acid residues at positions 7 (histidine), 10 (glycine), 12 (phenylalanine), 13 (threonine) and 15 (aspartic acid) are directly involved in interaction with the receptor. Furthermore, the amino acid residues at positions 28 (phenylalanine) and 29 (isoleucine) are very critical for GLP-1 to form a conformation that can be recognized by the receptor. Some studies have demonstrated that the amino acid residues at positions 10 (glycine), 15 (aspartic acid) and 17 (serine) in the sequence as well as the C-terminus of the sequence are very important for insulinotropic effect of GLP-1. For the effect of GLP-1, amidation at the C-terminus and the last amino acid residue at C-terminus are less important than the N-terminus.

The GLP-1 receptor antagonist is derivated primarily from the sequences resulting from N-terminal deletion or substitution of GLP-1 (7-36)-NH$_2$ or exendin-4, and comprises, but not be limited to, the following sequences:

1.
(SEQ ID NO: 207)
DLSKQMEEEAVRLFIEWLKNGGPSSGAPPPS-NH$_2$;

2.
(SEQ ID NO: 208)
HAKGTFTSDVSSYLEGQAAKEFIAWLVKGR-NH$_2$;

3.
(SEQ ID NO: 209)
EGTFTSDVSSYLEGQAAKEFIAWLVKGR-NH$_2$;

4.
(SEQ ID NO: 210)
AEGTFTSEVSSYLEGQAAKEFIAWLVKGR-NH$_2$.

The analogues of GLP-1 include these polypeptides which are different from GLP-1 (7-37) in the amino acid sequence by 1-15 of amino acid residues, comprising substitutions or modifications at positions 11, 12, 16, 22, 23, 24, 25, 26, 27, 30, 33, 34, 35, 36, and 37. Positions 18, 20, 23, 30, 31, 34, 36, 37 or the C-terminus of these polypeptides may be linked to a modifying group, such as an albumin binding molecule or polyethylene glycol, etc. (WO2009030738). The GLP-1 receptor binding polypeptide includes any polypeptide which has a GLP-1 receptor-binding capability amounting to 1%, 5%, 10%, 20%, 30%, 40%, 50%, 60%, 70%, 80%, 90%, 100%, or more than 100% of that of GLP-1 (7-36)-NH$_2$, and derivatives thereof, such as GLP-1 analogues, GLP-1 receptor agonists, GLP-1 receptor antagonists, dual-agonist (coagonist) of GLP-1 and glucagon receptors, chimeric polypeptides of the GLP-1 receptor agonists and the glucagon receptor antagonist, glucagon receptor antagonists and the derivatives of these polypeptides, including the sequences in publications and literatures, such as, U.S. Pat. No. 7,235,627, WO/2002/048192, WO/2004/093823, WO/2003/103572, WO/2008/101017, WO/2009/058734, WO/2009/155258, WO/2010/070253, WO/2010/070255, WO/2011/075393, WO/2011/080102, WO/2011/073328, EP2322545, EP 2322546, "Design of a Long Acting Peptide Functioning as Both a Glucagon-like Peptide-1 Receptor Agonist and a Glucagon Receptor Antagonist," The Journal of Biological Chemistry 2006, Vol. 281(18): 12506-12515.

With the progressive insight into GLP-1 and its correlation with diabetes, this field is becoming more focused by medicine R & D organizations at home and abroad. The representative medicaments are Exendin-4 and liraglutide.

Liraglutide has a similarity of 97% in amino acid sequence to human endogenous GLP-1 (7-37), with its sequence as follows:

(SEQ ID NO: 211)
HAEGTFTSDVSSYLEGQAAK(γE-C16)EFIAWLVRGRG-OH.

Other GLP-1-like candidate agents include albiglutide, taspoglutide, lixisenatide (AVE0010 or ZP10A), etc.

Albiglutide is a GLP-1 dimer fused to human albumin, which has a resistance to DPP-IV hydrolysis and a half-time of 4-7 days.

The sequence of Lixisenatide is (SEQ ID NO: 212)
HGEGTFTSDLSKQMEEEAVRLFIEWLKNGGPSSGAPPSKKKKKK-NH$_2$.

Taspoglutide is an amide derivative of the human GLP-1 (7-36) with the following modification: (2-methylalanine)-35-(2-methylalanine)-36-L-arginine and its sequence is (SEQ ID NO: 213)
HAibEGTFTSDVSSYLEGQAAKEFIAWLVKAibR-NH$_2$.

Exenatide, a synthetic product of exendin-4, consists of 39 amino acids and has a sequence homology of up to 53% with GLP-1 and the identical biological function. The sequence thereof is

HGEGTFTSDLSKQMEEEAVRLFIEWLKNGGPSSGAPPPS-NH$_2$. (SEQ ID NO: 214)

Exendin-3 is obtained from the secretory product of Heloderma horridum with the sequence

HSDGTFTSDLSKQMEEEAVRLFIEWLKNGGPSSGAPPPS-NH$_2$. (SEQ ID NO: 215)

"Exendin-3 analogue" is defined as the one in which one or more of the amino acid residues of Exendin-3 are deleted or substituted with other amino acid residues, or the one of which one or more of amino acid residues are inserted into the original polypeptide sequence. The analogues of Exendin-3 include these polypeptides which are different from exendin-3 in the amino acid sequence by 1-15 amino acid residues.

"Exendin-4 analogue" is defined as the one in which one or more of the amino acid residues of Exendin-4 are deleted or substituted with other amino acid residues, or the one of which one or more of amino acid residues are inserted into the original polypeptide sequence. In a preferred embodiment, total number of amino acid residues that are different between the exendin-4 analogue and exendin-4 may be not more than 15, 10, 5, 4, 3, and 2, most preferably be 1, such as leucine 14, phenylalanine 25-exendin-4. Exendin-4 analogues may be truncated fragments of exendin-4 such as exendin-4 (1-28)-NH$_2$, exendin-4 (1-30), exendin-4 (1-30)-NH$_2$, leucine 14, phenylalanine 25-exendin-4 (1-28)-NH$_2$, leucine 14, alanine 22, phenylalanine 25-exendin-4 (1-28)-NH$_2$.

The present invention encompasses the full length or truncated sequences of exendin-3 and exendin-4, comprising exendin-3 (1-30) or exendin-4 (1-30) sequences, in which the C-terminus of these sequences may be shorten by three amino acid residues, preferably one amino acid residue; and the N-terminus thereof may be shorten by two amino acid residues, preferably one amino acid residue. Although the amino acid sequences are shortened, all these fragments of exendin have biological activity.

The present invention comprises the sequences extending from C-terminus of exendin-3 and exendin-4. In one embodiment, C-terminal extension comprises 1-6 of positively charged amino acids such as arginine, lysine. In one embodiment, C-terminal extension comprises 1-6 of negatively charged amino acids such as glutamic acid, aspartic acid. In certain embodiments, the analogues of exendin-3 and exendin-4 may be a modified product such as a product subjected to alkyl substitution, acylation, polyethylene glycol modification, etc.

GLP-1 receptor binding polypeptides with exendin-3 and exendin-4 as templates include any polypeptide and a derivative thereof which has the GLP-1 receptor-binding capability amounting to 1%, 5%, 10%, 20%, 30%, 40%, 50%, 60%, 70%, 80%, 90%, 100%, or more than 100% of the capability of GLP-1 (7-36)-NH$_2$, comprising the sequences in the publications and patent documents, such as, the sequences mentioned in WO 97/46584, WO 98/05351, WO 99/25727, WO 99/25728, WO 99/07404, WO 99/40788, WO 00/41546, WO 00/41548, U.S. Pat. No. 7,691,963 B2, U.S. Pat. No. 7,407,932B2, U.S. Pat. No. 8,030,273B2, US 20010047084 A1, U.S. Pat. No. 5,424,286 A, WO/2013/002580, CN-200710138718.7, and CN200910135363.5, as well as in "EW, a novel recombinant analogue of exendin-4 expressed in *Escherichia coli*." Scientific Research and Essays 2011 Vol. 6(14): 2941-2949, "Site-specific PEGylation of exenatide analogues markedly improved their glucoregulatory activity" British Journal of Pharmacology, 2011, 163: 399-412.

GIP and GIP receptor binding polypeptide

Gastric inhibitory peptide is also known as glucose-dependent insulinotropic polypeptide, abbreviated as GIP. When the blood glucose concentration is high, GIP can regulate the blood glucose by facilitating secretion of the insulin. Furthermore, GIP plays a key role in adipocytes and fat metabolism.

The sequence of human GIP is

YAEGTFISDYSIAMDKIHQQDFVNWLLAQKGKKNDWKHNITQ. (SEQ ID NO: 216)

"GIP analogue" is defined as the one in which one or more of the amino acid residues of GIP are deleted or substituted with other amino acid residues, or the one of which one or more of amino acid residues are inserted into the original polypeptide sequence. In one embodiment, GIP analogue is at least 25%, 30%, 40%, 50%, 60%, 70%, 80%, and 90% identical in the sequence to the human GIP. In a preferred embodiment, total number of amino acid residues that are different between the GIP analogue and human GIP may be not more than 20, 15, 10, 5, 4, 3, and 2, most preferably be 1. In certain embodiments, the amino acid substitution may be at positions 1, 2, 3, 7, 10, 12, 15, 16, 17, 18, 19, 20, 21, 23, 24, 27, 28, and 29. GIP analogues may be truncated fragments of the GIP(1-42). In one embodiment, GIP analogues comprise the sequences obtained after removing 1-12 of the amino acid residues from C-terminus of the GIP(1-42), such as, GIP(1-38), GIP(1-39), GIP(1-30)-NH$_2$, etc. In one embodiment, GIP analogues comprise a polypeptide sequence of at least twelve amino acid residues starting from the N-terminus of GIP(1-42). In certain embodiments, GIP analogues comprise an extension of 1-20 of the amino acids at the C-terminus. In one embodiment, C-terminal extension comprises 1-6 of positively charged amino acids, such as arginine, lysine. In one embodiment, C-terminal extension comprises 1-6 of negatively charged amino acids, such as glutamic acid, aspartic acid. In certain embodiments, the GIP analogues may be a modified product, such as a product subjected to alkyl substitution, acylation, polyethylene glycol modification, etc.

GIP analogues and derivatives thereof may be found in a wide variety of literatures. Part of the GIP agonists can be found in the publications, such as, Salhanick, et al., Bioorg Med Chem Lett 2005, 15(18): 4114-4117; Green, et al., Diabetes 2005, 7(5): 595-604; Gault, et al., Biochem J 2002, 367 (Pt3): 913-920; Gault, et al., J Endocrin 2003; 176: 133-141; Irwin, et al., Diabetes Obes Metab 11(6): 603-610 (epub 2009), etc. Examples of other GIP analogues are N-AcGIP (LysPAL[37]) (Irwin, et al., "A Novel, Long-Acting Agonist of Glucose-Dependent Insulinotropic Polypeptide Suitable for Once-Daily Administration in Type 2 Diabetes", J Pharmacol Exp Ther, 2005 Vol. 314 No. 3:1187-1194), GIP(1-40), GIP(1-30)-NH$_2$, GIP(19-30)-NH$_2$, GIP(1-14) (Hinke, et al., "Identification of a bioactive domain in the amino-terminus of glucose-dependent insulinotropic polypeptide (GIP)", Biochimica et Biophysica Acta 2001, Vol. 1547:143-155). Since the C-terminal fragment of GIP is more potent in promoting adipogenesis, partial or complete removing of the C-terminus is one of the procedures that decrease the effect in this aspect of a GIP agonist, such as GIP(1-30)-NH$_2$. Studies on structure-activity relationship have shown that the fragment 19-30 of GIP is critical to insulin response ("The insulinotropic region of gastric inhibitory polypeptide; fragment analysis suggests the bioactive site lies between residues 19 and 30." Can J Physiol Pharmacol. 1996 January; 74(1):65-72).

One determinant important for GIP activities is hydrolysis of the N-terminus of the polypeptide by DPP-4 enzyme into inactive GIP(3-42). Appropriate modification on an N-terminal residue at position 1, 2, or 3 of GIP can result in a resistance to degradation by DPP-4, even increase the biological activities of the GIP analogues. [D-Ala2]-GIP(1-42) is a super agonist to GIP receptor in a normal mouse in comparison with the native GIP, while the supernormal activity is not correlated totally with its effect on insulin in blood ("Dipeptidyl Peptidase IV-Resistant [D-Ala2]Glucose-Dependent Insulinotropic Polypeptide (GIP) Improves Glucose Tolerance in Normal and Obese Diabetic Rats", Diabetes 2002 51: 652-661).

Removing N-terminal amino acid residues of GIP often yields GIP receptor antagonist. GIP(10-30)-NH$_2$, GIP(6-30)-NH$_2$ and GIP (7-30)-NH$_2$ are GIP receptor antagonists, in which the binding capacity of GIP(6-30)-NH$_2$ to the GIP receptor is comparable to that of GIP(1-42) (Gelling et al., "GIP(6-30 amide) contains the high affinity binding region of GIP and is a potent inhibitor of GIP1-42 action in vitro." Regul Pept. 1997, 69(3):151-154; "Postprandial stimulation of insulin release by glucose-dependent insulinotropic polypeptide (GIP). Effect of a specific glucose-dependent insulinotropic polypeptide receptor antagonist in the rat", J Clin Invest. 1996 December 1; 98(11): 2440-2445). Other GIP antagonists include GIP(15-42), GIP(15-30), GIP(16-30), and GIP(17-30). A GIP analogue Pro3-GIP ("Characterization of the cellular and metabolic effects of a novel enzyme-resistant antagonist of glucose-dependent insulinotropic polypeptide." Biochem Biophys Res Commun. 2002 February 8; 290(5):1420-6) antagonizes the effect of GIP in vitro in cells and in vivo in the obese diabetic ob/ob mice ("Effects of the novel (Pro(3)) GIP antagonist and exendin (9-39)amide on GIP- and GLP-1-induced cyclic AMP generation, insulin secretion and postprandial insulin release in obese diabetic (ob/ob) mice: evidence that GIP is the major physiological incretin." Diabetologia. 2003 February; 46(2): 222-30; "Effects of the novel (Pro(3)) GIP antagonist and exendin(9-39)amide on GIP- and GLP-1-induced cyclic AMP generation, insulin secretion and postprandial insulin release in obese diabetic (ob/ob) mice: evidence that GIP is the major physiological incretin. Diabetologia. 2003 February; 46(2):222-30). After injection with Pro3-GIP for 50 consecutive days, the adult, diabetic mice fed on a high-fat diet have decrease in body weight, in accumulation of adipose tissue, significant improvement in levels of glucose, saccharified hemoglobin and insulin, and decrease in levels of triglycerides in the muscle and the liver (McClean, et al., "GIP receptor antagonism reverses obesity, insulin resistance and associated metabolic disturbances induced in mice by prolonged consumption of high fat diet." Am J Physiol Endocrinol Metab. 2007 December; 293(6):E1746-55).

The features of type 2 diabetes include insulin resistance and dysfunction of pancreatic islet β cells with varying degree. In European and United States, insulin resistance and obesity are major pathological characteristics of patients with diabetes. In Asia, impaired insulin secretion is the main cause. Consequently, a GIP agonist is likely to benefit patients with impaired insulin secretion, in particular patients in Asia, while GIP inhibitor is likely to benefit obesity patients with insulin resistance, in particular patients in Europe and America.

In certain embodiments, the component from which a fusion protein or dimeric protein is formed together with the interleukin-1 receptor binding polypeptide are GIP agonists, GIP inhibitors, GLP-1/GIP receptors dual-agonists, glucagon/GIP receptors dual-agonists, GLP-1/GIP/glucagon receptors tri-agonists (e.g., those mentioned in WO/2010/011439, WO2010148089 A1, US2012/0172295, US 2011/0166062, US2012/0322725), GLP-1 agonists/GIP inhibitors, or chimeric polypeptide (e.g., HG-GIP(3-30)-NH$_2$, HG-GIP(3-30)-exendin-4 (31-39)-NH$_2$, Ser2-GIP(1-30)-NH$_2$, Ser2-GIP(1-30)-exendin-4 (31-39)-NH$_2$, dAla2-GIP (1-30)-exendin-4 (31-39)-NH$_2$). In the present invention, GIP receptor binding polypeptides may be any of the above-mentioned polypeptide sequences able to bind to GIP receptors. A GIP receptor binding polypeptide includes any polypeptide sequence with a binding capacity to the GIP receptor that amounts to 0.1%, 0.2%, 0.3%, 0.4%, 0.5%, 0.6%, 0.7%, 0.8%, 0.9%, 1%, 5%, 10%, 20%, 30%, 40%, 50%, 60%, 70%, 80%, 90%, 100% or higher of the binding capacity of GIP (1-42), and derivatives thereof, including GIP analogues.

GIP is effective in vitro in stimulating proliferation of 3 cells and protecting survival of β cells ("Glucose-Dependent Insulinotropic Polypeptide Is a Growth Factor for 3 (INS-1) Cells by Pleiotropic Signaling." Mol Endocrinol. 2001 September; 15(9):1559-70; "Mechanisms of mitogenic and anti-apoptotic signaling by glucose-dependent insulinotropic polypeptide in beta(INS-1)-cells", J Endocrinol. 2002 August, 174(2):233-46; "Glucose-dependent insulinotropic polypeptide promotes beta-(INS-1) cell survival via cyclic adenosine monophosphate-mediated caspase-3 inhibition and regulation of p38 mitogen-activated protein kinase", Endocrinology. 2003 October, 144(10):4433-45). Many studies have demonstrated that GIP analogues are very potent in protecting survival in the rat model of type 2 diabetes and in INS-1β cells ("A GIP receptor agonist exhibits beta-cell anti-apoptotic actions in rat models of diabetes resulting in improved beta-cell function and glycemic control", PLoS One. 2010 Mar. 9; 5(3):e9590; "GIP stimulation of pancreatic beta-cell survival is dependent upon phosphatidylinositol 3-kinase (PI3-K)/protein kinase B (PKB) signaling, inactivation of the forkhead transcription factor Foxo1 and downregulation of bax expression. J Biol Chem. 2005, 280(23):22297-307).

Since GIP exhibits protection on the pancreatic islet β cells, a fusion protein, dimeric protein or cross-linking protein consisting of the GIP and an interleukin-1 receptor binding polypeptide would exert better effects. In the present invention, the linking pattern for the GIP receptor binding polypeptide and the interleukin-1 receptor binding polypeptide can be referred to the pattern for GLP-1 receptor binding polypeptide and the interleukin-1 receptor binding polypeptide.

Interleukin-1 Receptor Antagonistic Protein:

An "interleukin-1 receptor antagonistic protein" includes an interleukin-1 receptor antagonist (an IL-1ra) and an analogue and derivative thereof.

The family of IL-1 receptors include several receptors. Accordingly, there are several different agonists and antagonists. These antagonists do not necessarily bind to the same IL-1 receptor from the family. Herein, the IL-1ra is used to stand for all of IL-1 antagonists of all receptors of the IL-1 receptor family. The IL-1ra includes human IL-1Ra (hIL-1Ra), an analogue, a derivative or a functional equivalent thereof. The functional equivalent has the biological activities of hIL-1Ra, such as capable of binding to the IL-1 receptor, not producing the downstream signal transduction, and hindering the binding of IL-1 to the IL-1 receptor. Examples may be referred to U.S. Pat. Nos. 6,096,728, 6,541,623, 6,365,726, and 6,399,573.

For description of the methods for preparing the preferred IL-1ra (including glycosylated and non-glycosylated forms) and use thereof, see U.S. Pat. No. 5,075,222, WO 91/08285, WO 91/17184, AU 9173636, WO 92/16221, and WO 96/22793. Specifically, U.S. Pat. No. 5,075,222 describes three forms of IL-1Ra. The first form IL-1Raa is characterized by the molecular weight of 22-23 kD on SDS-PAGE, an isoelectric point of approximately 4.8, and elution with a Tris buffer (pH 7.6) containing approximately 52 mM NaCl from Mono Q FPLC column. The second form IL-1Raβ is a protein with a molecular weight of 22-23 kD, and is eluted with a Tris buffer containing 48 mM NaCl from Mono Q FPLC column. Both the IL-1Raa and the IL-1Raβ are glycosylated. The third form IL-1Rax has the molecular weight of about 20 kD, is eluted with a Tris buffer containing 48 mM NaCl from Mono Q FPLC column, and non-glycosylated. The three antagonists have similar functions and immunological activities.

At present, it is known that IL-1Ra includes a secretory sub-type (sIL-1Ra) and three kinds of intracellular sub-type (icIL-1Ra1, 2, and 3).

The IL-1Ra set forth in the present invention may be a naturally secreted human IL-1Ra or a genetically recombinant human IL-1Ra, preferably a genetically recombinant human IL-1Ra.

In some embodiments, IL-1ra comprises anakinra and an analogue thereof. The sequence of anakinra is (SEQ ID NO: 217)
MRPSGRKSSKMQAFRIWDVNQKTFYLRNNQLVAGYLQGPNVNLEEKIDV

VPIEPHALFLGIHGGKMCLSCVKSGDETRLQLEAVNITDLSENRKQDKR

FAFIRSDSGPTTSFESAACPGWFLCTAMEADQPVSLTNMPDEGVMVTKF

YFQEDE.

in which two cysteines at positions 70 and 117 can form a disulfide linkage.

The IL-1ra and an analogue thereof in the present invention may be prepared and produced by using bioengineering technologies. For convenience of expressing and producing the protein, methionine can be added at the N-terminus of the sequences of the individual proteins in the present invention if needed, without influencing the biological activity of original sequence. Anakinra is the one where a methionine is added at the N-terminus of non-glycosylated hIL-1Ra.

In some embodiments, IL-1ra comprises one or more glycosylation moiety.

In the present invention, the amino acid sequence of IL-1ra can be altered without affecting the biological activity thereof. For example, one of the IL-1ra analogues may comprise one or more of conservative amino acid substitutions. The conservative amino acid substitution is the one where an amino acid residue is replaced with another amino acid residue having a similar side chain. Amino acid residues can be classified according to the nature of the side chain of an amino acid residue in literatures. Amino acid residues with a basic side chain comprise lysine, arginine, histidine; amino acid residues with an acidic side chain and an acylamide side chain comprise aspartic acid, glutamic acid, asparagine, glutamine; amino acid residues with small aliphatic, non-polar, or weak polar side chains comprise glycine, alanine, threonine, serine, proline; amino acid residues with large aliphatic and non-polar side chains comprise leucine, isoleucine, valine; aromatic amino acid residues comprise phenylalanine, tryptophan, tyrosine; amino acid residues with a sulphur-containing side chain comprise cysteine and methionine.

An IL-1ra analogue involved in the present invention comprises deletion of part of the amino acid residues in the amino acid sequence of IL-1ra (deletion analogue), substitutions with natural or non-natural amino acid residues (substitution analogue) or insertions (insertion analogue). The IL-1ra deletion analogue can typically have about 1-50 of amino acid residue deleted, more commonly have 1-10 of residues deleted. The IL-1ra insertion analogue may include fusion at the N- or C-terminus of IL-1ra, as well as one or more amino acid residues inserted into the internal sequence of IL-1ra. The terminal insertion of IL-1ra includes a chimeric protein. In one embodiment, the chimeric protein includes IL-1ra and the whole or parts of the constant regions in the heavy or light chain of a human immunoglobulin. The immunoglobulin portion of the preferred chimeric protein may comprise all constant regions except the first domain in the heavy chain constant regions of a human immunoglobulin (e.g., IgG, IgA, IgM, or IgE). Any amino acid residue in the immunoglobulin portions can be deleted or substituted with one or more of amino acid residues, or can be inserted with one or more of amino acid residues, so long as said IL-1ra still antagonize the IL-1 receptor, and the immunoglobulin portions exhibit one or more of their characteristic properties. The chimeric protein at the terminus of IL-1ra can also comprise the partial or whole sequence of human albumin, any amino acid residue in the albumin portion can be deleted or substituted with one or more of amino acid residues, or can be inserted with one or more of amino acid residues.

Analogues of the interleukin-1 receptor antagonistic protein set forth in the present invention is homologous approximately to IL-1Ra. The term "homologous approximately to" used herein refers to the degree of homology more than 60%, 70%, 80%, 90%, even more than 95%. The homology percentage set forth herein is calculated by an algorithm described by Dayhoff (Atlas of Protein Sequence and Structure, 5:124 (1972), National Biochemical Research Foundation, Washington, D.C.).

The IL-1ra can have a biological activity amounting to 1%, 2%, 3%, 4%, 5%, 10%, 20%, 30%, 40%, 50%, 60%, 70%, 80%, 90%, 100% or higher of the biological activity of hIL-1Ra for interleukin-1 receptor.

The person skilled in the art can prepare a chemically or biologically modified IL-1ra, an analogue, and a derivative thereof. A conjugate can be prepared with a glycosylated, non-glycosylated or deglycosylated IL-1ra and an IL-1ra analogue, and a chemically modifying group used includes water-soluble polymers (e.g., polyethylene glycol) and fatty acids. One IL-1ra analogue may comprise one or more of modifying groups. The chemically modifying group is typically linked to the IL-1ra through an α- or ε-amino group of an amino acid residue or an active thiol group in the IL-1ra. An amino acid residue having free amino group includes lysine residue and an amino acid residue at the N-terminus. An amino acid residue having active thiol group includes cysteine residue.

Special substitution of an amino acid residue in the IL-1ra sequence may be of particular use, e.g., addition of a cysteine or lysine residue is favorable to linkage of modifying groups according to the embodiment method to form a conjugate. In addition, a N- or O-linked glycosylated site can be added or deleted in the sequence of IL-1ra. An asparagine-linked glycosylation recognition site includes tripeptide sequences Asn-Xaa-Ser/Thr recognized by a suitable cellular glycosylase, wherein Xaa may be any of the natural amino acids except Pro. In a mature hIL-1Ra, the asparagine at position 84 is a glycosylated site. The molecular weight of the glycosylated IL-1ra can be varied depending on the varied degree of glycosylation. The interleukin-1 receptor antagonistic protein portion in the fusion protein, dimeric protein or cross-linking protein may be linked to the modifying group (e.g., polyethylene glycol) through a mercapto group on the side chain of cysteine.

The numbering for the amino acid residues in a mature hIL-1Ra is based on the following amino acid sequence, with the position of the first amino acid residue at N-terminus being the first position:

(SEQ ID NO: 218)
RPSGRKSSKMQAFRIWDVNQKTFYLRNNQLVAGYLQGPNVNLEEKIDVV

PIEPHALFLGIHGGKMCLSCVKSGDETRLQLEAVNITDLSENRKQDKRF

AFIRSDSGPTTSPESAACPGWFLCTAMEADQPVSLTNMPDEGVMVTKFY

FQEDE.

Four cysteines (C66, C69, C116, and C122) are present in the sequence of the above-mentioned natural IL-1ra. According to the method implemented in the present invention, the cysteine at position 116 (C116) is the special site in IL-1ra at which the modifying group (e.g., mono-polyethylene glycol) activated by maleimide or haloacetyl (e.g., I—CH$_2$—CO—) is reacted. In human IL-1ra, the other three cysteines is not easy to be reacted with the modifying group activated by maleimide or haloacetyl. For linking the modifying group to different sites of IL-1ra or conferring more than one modifying groups on IL-1ra, a cysteine residue can be substituted for an amino acid residue at the particular site. The IL-1ra analogues include the sequences where the cysteine residue is added at the N- or C-terminus of a protein, the sequences where the cysteine residue is substituted for the amino acid residues at original positions 6, 8, 9, 84, or 141, or the sequences where the cysteine at position 116 is substituted with a serine or one or more of the four cysteines is substituted with a serine. In addition to the IL-1ra with a single modifying group, the IL-1ra may further comprise the combination of the above-mentioned modifications, so that more than one cysteine will be reacted with the modifying groups.

The sequences of the IL-1ra analogues in the corresponding section are as follows:

(SEQ ID NO: 219)
CRPSGRKSSKMQAFRIWDVNQKTFYLRNNQLVAGYLQGPNVNLEEKIDVV

PIEPHALFLGIHGGKMCLSCVKSGDETRLQLEAVNITDLSENRKQDKRFA

FIRSDSGPTTSFESAASPGWFLCTAMEADQPVSLTNMPDEGVMVTKFYFQ

EDE;

(SEQ ID NO: 220)
CRPSGRKSSKMQAFRIWDVNQKTFYLRNNQLVAGYLQGPNVNLEEKIDVV

PIEPHALFLGIHGGKMCLSCVKSGDETRLQLEAVNITDLSENRKQDKRFA

FIRSDSGPTTSFESAACPGWFLCTAMEADQPVSLTNMPDEGVMVTKFYFQ

EDE;

(SEQ ID NO: 221)
CRPSGRKSSKMQAFRIWDVNQKTFYLRNNQLVAGYLQGPNVNLEEKIDVV

PIEPHALFLGIHGGKMCLSCVKSGDETRLQLEAVCITDLSENRKQDKRFA

FIRSDSGPTTSFESAASPGWFLCTAMEADQPVSLTNMPDEGVMVTKFYFQ

EDE;

(SEQ ID NO: 222)
RPSGRKSSKMQAFRIWDVNQKTFYLRNNQLVAGYLQGPNVNLEEKIDVVP

IEPHALFLGIHGGKMCLSCVKSGDETRLQLEAVCITDLSENRKQDKRFAF

IRSDSGPTTSFESAASPGWFLCTAMEADQPVSLTNMPDEGVMVTKFYFQE

DE;

(SEQ ID NO: 223)
RPSGRKSSKMQAFRIWDVNQKTFYLRNNQLVAGYLQGPNVNLEEKIDVVP

IEPHALFLGIHGGKMCLSCVKSGDETRLQLEAVCITDLSENRKQDKRFAF

IRSDSGPTTSFESAACPGWFLCTAMEADQPVSLTNMPDEGVMVTKFYFQE

DE;

(SEQ ID NO: 224)
RPSGRCSSKMQAERIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSPESAASPGWFLCTAMEADQPVSLTNMPDEGVMVTKFYFQE

DE;

(SEQ ID NO: 225)
RPSGRCSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSPESAACPGWFLCTAMEADQPVSLTNMPDEGVMVTKFYFQE

DE;

(SEQ ID NO: 226)
RPSGRKSCKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSPESAASPGWFLCTAMEADQPVSLTNMPDEGVMVTKFYFQE

DE;

(SEQ ID NO: 227)
RPSGRKSCKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSPESAACPGWFLCTAMEADQPVSLTNMPDEGVMVTKFYFQE

DE;

(SEQ ID NO: 228)
RPSGRKSSCMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSPESAASPGWFLCTAMEADQPVSLTNMPDEGVMVTKFYFQE

DE;

(SEQ ID NO: 229)
RPSGRKSSCMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSPESAACPGWFLCTAMEADQPVSLTNMPDEGVMVTKFYFQE

DE;

or (SEQ ID NO: 230)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSPESAASPGWFLCTAMEADQPVSLTNMPDEGCMVTKFYFQE

DE.

All of these IL-1ra analogues may be used in synthesis of the fusion protein, dimeric protein or cross-linking protein of the present invention.

Modifying Moiety

Fusion proteins may contain one or more modifying moieties which provide a fusion protein, a dimeric protein, or a cross-linking protein with desired properties. For example, a modifying moiety can reduce the rate of degradation of a protein in various environments (such as the digestive tract and the blood). Preferred modifying moieties are those which permit a protein to retain a comparative binding activity to the receptor. Further, preferred modifying moieties are those which are amphiphilic or hydrophilic, or which make the modified protein more hydrophilic and less lipophilic than a corresponding unmodified protein. The modifying moieties may include degradable or hydrolizable linkages, such as lactide, glycolide, carbonate, ester, carbamate and the like. This approach allows the polymers to be degraded into lower molecular weight fragments.

The modifying moiety can include one or more hydrophilic moieties, lipophilic moieties, amphiphilic moieties, salt forming moieties, spacer moieties, linking moieties, and terminating moieties, and combinations thereof. The various moieties can be linked together by a covalent bond, or by hydrolizable or non-hydrolizable bonds. Representative hydrophilic, lipophilic and amphiphilic moieties are described in more detail below.

Hydrophilic Moieties

Examples of suitable hydrophilic moieties include PAG moieties, polysaccharides, polysorbate moieties, and combinations thereof.

Polyalkylene glycol (PAG) consists of multiple alkylene glycol units. In one embodiment, the units are all identical (e.g., polyethylene glycol (PEG) or polypropylene glycol (PPG)). In another embodiment, the alkylene glycol units are different. The polymers can be random copolymers (for example, the copolymer of ethylene oxide and propylene oxide) or branched or graft copolymers.

PEG in present invention is any water soluble polyethylene glycol or polyethylene oxide. PEG has the formula $-(CH_2CH_2O)_n-$, where n is an integer from 2 to 2000. One end of PEG is usually an inert functional group, e.g., an alkyl or alkoxy etc. Although PEG capped with a methoxy group is named mPEG with the formula $CH_3O(CH_2CH_2O)_n-$, they are still generally called PEG PEG20K is a polyethylene glycol of molecular weight 20,000.

The other end of PEG is generally an activated functional group or a functional group prone to form a covalent linkage, such as amino, carboxyl group, hydroxyl, mercapto group, aldehyde, etc. PEG-maleimide can be attached to the mercapto group on the side chain of a cysteine through Michael addition reaction; PEG-iodoacetyl ($CO-CH_2-I$) is reacted with the mercapto group-SH to form a stable thioether bond; PEG-NHS (succinimide) can be attached to the α-amino group of an amino acid residue or the ε-amino group on the side chain of a lysine through a nucleophilic substitution reaction (acylation); PEG-aldehyde can be attached to the amino group on a polypeptide under the action of a reductant (e.g., sodium cyano borhydride) through reductive alkylation reaction.

The commercial PEG reagents used in the invention include, but are not limited to, mPEG-SC (methyoxy-PEG-succinimidyl carbonate), mPEG-NHS (SCM) (or mPEG-SPA, succinimidyl ester of monomethoxypoly (ethylene glycol) propionic acid), NHS-PEG-NHS, mPEG-CHO (methoxy-PEG-propionaldehyde), ALD-PEG-ALD (acetaldehyde-PEG-acetaldehyde), PEG-Ts (methoxy-PEG-toluenesulfonic acid), Ts-PEG-Ts (toluenesulfonic acid-PEG-toluenesulfonic acid), mPEG-CDI (methoxy-PEG-carbonyl imidazole), CDI-PEG-CDI (carbonyl imidazole-PEG-carbonyl imidazole), mPEG-NPC (methoxy-PEG-nitrophenyl carbonate), mPEG-ISC (PEG-isocyanate), ISC-PEG-ISC (isocyanate-PEG-isocyanate), mPEG-EPO (methoxy-PEG-epoxide), EPO-PEG-EPO (epoxide-PEG-epoxide), mPEG-Mal (methoxy-PEG-maleimide), Mal-PEG-Mal (maleimide-PEG-maleimide), maleimide-PEG-NHS, maleimide-PEG-NH$_2$, maleimide-PEG-COOH, PEG-vinyl sulfone derivatives, (VS-PEG-X, X=NHS, maleimide, NH$_2$, COOH, etc), PEG-iodoacetamide derivatives (IA-PEG-X, X=NHS, maleimide, NH$_2$, COOH, etc.), mPEG-OPSS (methoxy-PEG-orthopyridyl disulfide), OPSS-PEG-NHS (orthopyridyldisulfide-PEG-succinimidyl ester), OPSS-PEG-NH$_2$, OPSS-PEG-OPSS.

The PEG in this invention can be linear, branched, forked, or dumbbell shaped. In one embodiment, a branched PEG can be represented by general formula $R(-PEG-_nOH)_m$ in which R represents a core group (typically polyhydric) such as pentaerythritol, sugar, lysine or glycerol; m represents the number of branches, and ranges from 2 to the maximum number of attachment sites on the core group; and n represents the number of PEG the number of PEG on each branch may be different. In another embodiment, a branched PEG can be represented by the general formula $(CH_3O-PEG-_n)_p R-Z$, in which p equals 2 or 3, R is lysine or glycerol, Z is a reactive group. In one embodiment, forked PEG can be represented by the general formula $PEG(-L-X)_n$, in which L is a linking group and X represents a terminal reactive group.

PEG can be polydisperse with a polydispersity index less than 1.05. PEG can also be monodisperse. A monodisperse PEG is composed of molecules of the same length (molecular weight) rather than a mixture of molecules of similar length (molecular weight).

The term "alkyl" comprises saturated straight or branched hydrocarbon groups.

The term "alkoxy" comprises the free radical "alkyl-O—". The representative example is methoxy, ethoxy, propoxy (e.g., 1-propoxy and 2-propoxy), butoxy (e.g., 1-butoxy, 2-butoxy, and 2-methyl-2-propoxy), pentyloxy, hexyloxy, etc.

Saccharide Moieties

Polypeptides and proteins in this invention can contain glycosylation sites. Glycosylation can not only improve drug efficacy and pharmacokinetics of a drug, but also act in drug targeting and delivery. A saccharide moiety can be O-linked or N-linked. O-linked saccharide is generally attached to the oxygen atom of hydroxyl group in serine or threonine. N-linked saccharide is attached to the nitrogen atom of the side chain amide in asparagine. Although GLP-1 receptor binding polypeptides are not usually glycosylated, serine at the C terminal of GLP-1-PSSGAPPPS-IgG Fc (SEQ ID NO:283) can be glycosylated and threonine (AE-PKSCDKTHTCP . . . ) (SEQ ID NO:290), the 11$^{st}$ amino acid residue at the N-terminal of Fc, can also be glycosylated.

Representative saccharide moieties include, but are not limited to, glycerol moieties, monosaccharide, disaccharide, trisaccharide, oligosaccharides, and polysaccharides such as starches, glycogen, cellulose and/or polysaccharide gums. Specific monosaccharides include C6 and above (preferably C6 to C8) saccharides such as glucose, fructose, mannose, galactose, ribose, and sedoheptulose; disaccharides and trisaccharides include moieties having two or three monosaccharide units (preferably C5 to C8) such as sucrose, cellobiose, maltose, lactose, and raffinose.

Other Hydrophilic Groups

Biocompatible polycation groups include polyamines having multiple amino groups on either the backbone or the side chains, such as poly(lysine) and other polyamino acids having multiple positive charges formed by natural or synthetic amino acids, including poly(ornithine), poly(arginine), and poly(histidine), and nonpolypeptide polyamines such as poly(aminostyrene), poly(aminoacrylate), poly (N-methyl aminoacrylate), polymers of quaternary amine etc. Biocompatible polyanion groups include groups having multiple carboxyls on either the backbone or the side chains, such as poly(aspartic acid) and poly(glutamic acid) etc. Other hydrophilic groups include natural or synthetic polysaccharides such as chitosan and glucan etc.

Polyanionic Bio-adhesives

Certain hydrophilic groups appear to have potentially useful bio-adhesive properties. Examples of such groups are found, for example, in U.S. Pat. No. 6,197,346. Those polymers containing multiple carboxyls exhibit bio-adhesive properties. Rapidly biodegradable polymers that expose multiple carboxyls upon degradation, such as poly(lactide-co-glycolide), polyanhydrides, and polyorthoesters, are also bio-adhesives. These polymers can be used to deliver polypeptide and protein drugs to the gastrointestinal tract. As the polymers degrade, they can expose carboxyl groups to enable them to adhere strongly to the gastrointestinal tract, so as to aid in the delivery of polypeptide and protein drugs.

Lipophilic Moieties

In one embodiment, the modifying moieties include one or more lipophilic moieties. The lipophilic moiety may be those well known by the skilled in the art, which include, but not limited to, alkyl, alkenyl, alkynyl, aryl, arylalkyl, alkylaryl, fatty acids, cholesteryl, lipophilic oligomers and polymers.

The hydrocarbyl can be a saturated or unsaturated, linear, branched, or cyclic hydrocarbon having one or more carbon atoms. In one embodiment, the hydrocarbyl has 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more carbon atoms. The hydrocarbyl can either be unsubstituted or substituted with one or more substituents.

The lipophilic moiety may be a fatty acid, such as a natural or synthetic, saturated or unsaturated, linear or branched fatty acid. In one embodiment, the fatty acid has 2, 3, 4, 5, 6, 7, 8, 9, 10, 11, 12, 13, 14, 15, 16, 17, 18, 19, 20, 21, 22, 23, 24, or more carbon atoms.

Conjugation Strategies

The degree of conjugation of a protein with modifying moieties, selection of conjugation sites and selection of modifying moieties may be varied according to actual requirements, for example, to make the conjugate less susceptible to in vivo degradation, and thus has an increased plasma half-life. A conjugation site may include an amino acid residue such as lysine. In one embodiment, protein conjugates are mono-conjugates. In another embodiment, protein conjugates are multi-conjugates. In some embodiments, protein conjugates are a mixture of mono-conjugate, di-conjugates, tri-conjugates, tetra-conjugates and the like. The modifying moieties may be the same, or different from one another. When a protein conjugate has a plurality of modifying moieties, it may be preferable to couple one or more of the modifying moieties to a fusion protein with hydrolyzable bonds and couple other modifying moieties to the fusion protein with non-hydrolyzable bonds. Alternatively, all of the bonds coupling the modifying moieties to a fusion protein may be hydrolyzable but have varying hydrolysis rates in vivo.

An ideal conjugation strategy is one in which a conjugate is endowed with some or all biological activities of the original protein. The preferred conjugation sites of an insulin receptor binding polypeptide includes B1 (N-terminus) of a double chain insulin analogue, the amino group on the side chain of a lysine or the mercapto group on the side chain of a cysteine originally present or introduced after substitution or insertion at the C-terminus of B chain, the amino group on the side chain of a lysine or the mercapto group on the side chain of a cysteine introduced after substitution or insertion at the C-terminus of A chain, the amino group on the side chain of a lysine or the mercapto group on the side chain of a cysteine originally present or introduced after substitution or insertion at the N- or C-terminus of a single chain insulin analogue. A B1 mono-conjugate and a di-conjugate of the B chain are most commonly used. Furthermore, other conjugation sites can be created by embedding a natural or non-natural amino acid having an amino or mercapto group into the C peptide linker, or the A chain, the B chain of a single chain insulin analogue. The conjugation sites used most commonly in an interleukin-1 receptor binding polypeptide include the mercapto group on the side chain of a cysteine at positions 84 and 116 or the amino group at the N-terminus. The conjugation sites used most commonly in a GLP-1 analogue include the amino group on the side chain of a lysine or the mercapto group on the side chain of a cysteine at positions 10, 20, and 28 starting from N-terminus of GLP-1 (7-37)-OH or GLP-1 (7-36)-NH$_2$, originally present or introduced after substitution or insertion, or the amino group on the side chain of a lysine or the mercapto group on the side chain of a cysteine introduced after substitution or insertion at the C-terminus. The conjugation sites used most commonly in an Exendin-4 analogue include the amino group on the side chain of a lysine or the mercapto group on the side chain of a cysteine at positions 12, 20, 27, 28 and 32 starting from N-terminus of Exendin-4, originally present or introduced after substitution or insertion, or the amino group on the side chain of a lysine or the mercapto group on the side chain of a cysteine substituted or inserted at the C-terminus.

A modifying moiety may be coupled to a protein with a hydrolyzable bond (e.g., an ester, carbonate or hydrolyzable carbamate bond). Use of a hydrolyzable bond will allow a protein conjugate to act as a prodrug. For example, when a modifying moiety conjugation site is in a binding region of a protein to the receptor, the conjugate of the protein and modifying moiety lacks activity. The active protein is released as one or more modifying moieties are detached from the conjugate. Use of a hydrolyzable bond can also provide a delayed-release or controlled-release effect.

In one example, a protein is coupled to a modifying moiety by a non-hydrolyzable bond (such as amide bond and ether bond). And the non-hydrolyzable bond may contribute to the prolongation of circulation time for protein conjugate in the plasma if necessary.

A protein, protein analogue, or protein derivative may be coupled to the modifying moiety by a various nucleophilic functional groups, including, but not limited to, nucleophilic hydroxyl or amino. Nucleophilic hydroxyl may be found, for example, in serine, threonine, or tyrosine, and nucleophilic amino may be found, for example, in histidine, Lysine or at the N-terminus of the A or B chains of insulin or insulin analogue. A protein may be coupled to a modifying moiety by a free —SH group, e.g., by forming a thioester, thioether or sulfonate bond.

One of the reasons for short circulation time of small molecular weight polypeptides or proteins in the plasma is renal clearance. Increasing the molecular weight of polypeptides or proteins to the critical point for renal clearance of over 40,000 daltons will significantly reduce the renal clearance rate and prolong duration of action of the polypeptides. One common approach is to conjugate a protein or polypeptide to a natural or synthetic large molecule via a hydrolysable or non-hydrolysable bond. Biomacromolecules include albumin, polysaccharides (such as glucan), and antibody (such as IgG) etc. Albumin and IgG account for 90% of plasma proteins and have weeks of in vivo circulation time. Polypeptides conjugated to albumin or IgG Fc display a markedly longer in vivo circulation time. For example, etanercept is a product of soluble TNF2 receptor bound to the IgG1 Fc, such a receptor dimer with a 150 kDa molecular weight is an effective antiinflammatory agent which is administered twice weekly ($t_{1/2}$=102 hours). Recently approved romiplostim for stimulation of platelet production is another example of IgG fusion protein.

The albumin may be human albumin (HSA), an analogue of human albumin or a portion of human albumin. Human albumin comprises 585 of amino acid residues with a molecular weight of 66500. EP322,094 provides shorter sequences of human albumin, including HAS (1-373), HAS (1-388), HAS (1-389), HAS (1-369), HAS (1-419), and the fragment between amino acid positions 1-369 and 1-419. The sequences provided in EP399666 include HAS (1-177), HAS (1-200), and the fragment between HSA (1-177) and HAS (1-200). The Fc portion of an immunoglobulin may be the Fc portion of a human immunoglobulin, an analogue of the Fc portion of human immunoglobulin, a fragment of the Fc portion of human immunoglobulin, etc. Fc may comprise the hinge-region, $C_{H2}$, $C_{H3}$ up to the C-terminus. A major reason for the Fc fusion protein to extend the in vivo circulation time is that the Fc is able to bind to FcRn. FcRn distributes over the surface of endothelial cells, binds to IgG in a pH-dependent manner, and protects IgG from degradation. Variations at the interface between $CH_2$ and $CH_3$ may extend the half-time of IgG (Hinton P R, et al., 2004. Engineered human IgG antibodies with longer serum half-lives in primates. J Biol Chem. 279(8):6213-6; Vaccaro C., et al., 2005. Engineering the Fc region of immunoglobulin G to modulate in vivo antibody levels. Nat Biotechnol. 23(10):1283-8). As 70% of albumins in the blood vessel are mercaptalbumin, the mercapto group on the side chain of the cysteine-34 is the most active mercapto group in the blood plasma. The inventive protein, analogue, or derivative thereof may be reacted with it by a linking group with an active functional group at one of its ends such as maleimide, etc., to generate a fusion protein-albumin conjugate. In one embodiment, the N- or C-terminus of the protein in the present invention can be linked to the N- or C-terminus of the albumin or immunoglobulin Fc. This linking strategy enables the circulation time of small molecule weight compound to reach the half-time of plasma protein to which it binds, but at the price of possible decrease in the receptor binding affinity. One of the solutions to the above is insertion of a spacer group between the polypeptide (or the protein) and the modifying group. The spacer group, such as β-alanine, γ-aminobutyric acid, γ-glutamic acid or polyethylene glycol, may be used between an amino group of the polypeptide/protein and a modifying group. Palmitic acid group of Liraglutide is linked to the side chain of a lysine through a spacer group. An additional solution is that the modifying group is linked to the polypeptide/protein through a "reversible" linking group.

The Fusion Protein/Dimeric Protein/Cross-Linking Protein

The fusion protein, dimeric protein or cross-linking protein referred in the present invention is a product obtained by linking a GLP-1 receptor binding polypeptide, a GIP receptor binding polypeptide or an insulin receptor binding polypeptide to an interleukin-1 receptor antagonistic protein. The two portions of the polypeptide/protein can be directly linked and can also be linked through a linking group (or a spacer group). The fusion protein/dimeric protein/cross-linking protein can have a biological activity for an interleukin-1 receptor amounting to 1%, 5%, 10%, 20%, 30%, 40%, 50%, 60%, 70%, 80%, 90%, 100%, or higher of the biological activity of IL-RA, while as to the other portion, the GLP-1 receptor binding polypeptide, the GIP receptor binding polypeptide, or the insulin receptor binding polypeptide has a biological activity for a GLP-1 receptor, a GIP receptor, or an insulin receptor, respectively amounting to 0.1%, 0.2%, 0.3%, 0.4%, 0.5%, 1%, 5%, 10%, 20%, 30%, 40%, 50%, 60%, 70%, 80%, 90%, 100% or higher of the biological activity of GLP-1 (7-36)-$NH_2$, GIP (1-42), or the human insulin, respectively.

The fusion protein, dimeric protein, cross-linking protein and derivatives thereof in the present invention may be prepared and produced by using bioengineering technologies. For convenience of expressing and producing the protein, methionine can be added at the N-terminus of the sequences of the individual proteins of the present invention according to the requirements.

The linking group (or the spacer group) may be chemically synthesized molecules, such as long-chain fatty acids or polyethylene glycol, and may also be a natural or non-natural amino acid (e.g., lysine, glutamic acid, aspartic acid), a short peptide (e.g., β-alanine-β-alanine), a protein, or a long chain formed by one or more optional long-chain fatty acids, polyethylene glycol, amino acids, short peptides, etc linked together through covalent bonds, or any structure connecting two active polypeptides/proteins through a covalent bond, or absent.

Through a chemical reaction, the linking group may connect two polypeptides/proteins originally not attached (one is an interleukin-1 receptor antagonistic protein, the other is a GLP-1 receptor binding polypeptide, a GIP receptor binding polypeptide, or an insulin receptor binding polypeptide). In one embodiment, the linking group may have two activating groups (e.g., N-hydroxyl succinimide (NHS ester) or maleimide), each of which is reacted with the amino or mercapto group on the interleukin-1 receptor antagonistic protein and the GLP-1 receptor binding polypeptide (or the GIP receptor binding polypeptide or the insulin receptor binding polypeptide), linking the three components as a whole. In one embodiment, the linking group may have an activating group (e.g., NHS ester, maleimide, iodoacetyl, or vinylsulfone) and a functional group (e.g., an amino or mercapto group), each of which is reacted respectively with a functional group (e.g., an amino or mercapto group) and an activating group (e.g., NHS ester, maleimide, iodoacetyl, or vinylsulfone) on the interleukin-1 receptor antagonistic protein and the GLP-1 receptor binding polypeptide (or the GIP receptor binding polypeptide or the insulin receptor binding polypeptide), linking the three components as a whole. In another embodiment, the linking group may have two functional groups (e.g., an amino or mercapto group), each of which is reacted with the activating groups (e.g., NHS, maleimide, iodoacetyl, or vinylsulfone) on the interleukin-1 receptor antagonistic protein and the GLP-1 receptor binding polypeptide (or the GIP receptor binding polypeptide or the insulin receptor binding polypeptide), linking the three components as a whole. The positions of activating group and functional group needs to be determined according to the requirement for a particular reaction.

If the linking group is already linked to a biologically active polypeptide (e.g., an interleukin-1 receptor antagonistic protein) and is to be linked through a chemical reaction to another biologically active polypeptide originally not attached, the reaction mode is similar to the above. For connection of the linking group already linked to a polypeptide to another polypeptide originally not attached, one entity is required to have a functional group (e.g., an amino or mercapto group) and the other is required to have a reactive group (e.g., NHS ester, maleimide, iodoacetyl, or vinylsulfone). As for location of the reactive group and the functional group in the linking group or the polypeptide, it needs to be determined according to the requirement from a particular reaction.

In one particular embodiment, the linking group (or the spacer group) comprises one or more lysine or cysteine residues, of which the amino or mercapto groups on the side chains are used to be reacted with the modifying group. In one embodiment, the GLP-1 receptor binding polypeptide, the GIP receptor binding polypeptide or the insulin receptor binding polypeptide is linked to the interleukin-1 receptor antagonistic protein through a short peptide, forming a single-chain fusion protein. The general formula for the short peptide is (GlyGlyGlyGlySer)$_n$ (SEQ ID NO:436), wherein n is a 0, 1, 2, 3, 4, 5, or 6.

1. the fusion protein consisting of the GLP-1 receptor binding polypeptide and the interleukin-1 receptor antagonistic protein In one embodiment, the sequence of the GLP-1 receptor binding polypeptide on the basis of the human GLP-1 is (SEQ ID NO: 231)
X$_{G1}$X$_{G2}$X$_{G3}$GX$_{G5}$X$_{G6}$TSDX$_{G10}$SX$_{G12}$YLEX$_{G16}$X$_{G17}$X$_{G18}$AX$_{G20}$

X$_{G21}$FIX$_{G24}$X$_{G25}$LX$_{G27}$X$_{G28}$X$_{G29}$X$_{G30}$X$_{G31}$, wherein X$_{G1}$ is a histidine, D-histidine, deamino-histidine, β-hydroxyl-histidine, homohistidine, α-fluoromethyl-histidine, α-methyl-histidine, N-methyl-histidine, N$^α$-acetyl-histidine, α-methyl-histidine, 2-pyridinyl-alanine, 3-pyridinyl-alanine, 4-pyridinyl-alanine, imidazopropionyl; X$_{G2}$ is a 2-methylalanine (Aib), glycine, D-serine, serine, threonine, leucine, isoleucine, alanine, valine, aminocyclopropanecarboxylic acid, aminocyclobutanecarboxylic acid, aminocyclopentanecarboxylic acid, aminocyclohexanecarboxylic acid, aminocycloheptanecarboxylic acid, or aminocyclooctanecarboxylic acid; X$_{G3}$ is a glutamic acid, aspartic acid, or glutamine; X$_{G5}$ is a threonine, aspartic acid, glutamic acid, arginine, alanine, lysine, or histidine; X$_{G6}$ is a phenylalanine, tyrosine, tryptophan, or histidine; X$_{G10}$ is a valine, tyrosine, phenylalanine, tryptophan, histidine, leucine, isoleucine, serine, threonine, aspartic acid, glutamic acid, alanine, lysine, arginine, cysteine, general formula 1, or general formula 2; X$_{G12}$ is a serine, isoleucine, lysine, arginine, cysteine, general formula 1, or general formula 2; X$_{G16}$ is a glycine, serine, histidine, glutamic acid, aspartic acid, glutamine, asparagine, lysine, arginine, homoglutamic acid, cysteine, homocysteine, or cysteic acid; X$_{G17}$ is a glutamine, arginine, isoleucine, glutamic acid, aspartic acid, histidine, lysine, cysteine, general formula 1, or general formula 2; X$_{G18}$ is an alanine, arginine, histidine, glutamic acid, or lysine; X$_{G20}$ is lysine, arginine, aspartic acid, glutamic acid, glutamine, histidine, 2-methylalanine, cysteine, general formula 1, or general formula 2; X$_{G21}$ is an aspartic acid, glutamic acid, leucine, alanine, lysine, cysteine, general formula 1, or general formula 2; X$_{G24}$ is an alanine, glutamine, asparagine, glutamic acid, aspartic acid, serine, or histidine; X$_{G25}$ is an alanine, tryptophan, phenylalanine, tyrosine, cysteine, lysine, general formula 1, or general formula 2; X$_{G27}$ is a valine, leucine, lysine, arginine, alanine, glycine, cysteine, general formula 1, or general formula 2; X$_{G28}$ is a lysine, arginine, aspartic acid, glutamic acid, alanine, asparagine, cysteine, general formula 1, or general formula 2; X$_{G29}$ is a glycine, glutamine, threonine, serine, lysine, arginine, cysteine, general formula 1, or general formula 2; X$_{G30}$ is an arginine, lysine, glycine, histidine, cysteine, general formula 1, or general formula 2; X$_{G31}$ is a —NH$_2$, glycine, threonine, serine, aspartic acid, glutamic acid, tryptophan, tyrosine, phenylalanine, histidine, arginine, lysine, cysteine, a linking or spacer group, general formula 3, general formula 4 or a linking or spacer group+X$_{G32}$, in which X$_{G32}$ is a lysine, cysteine, general formula 3, general formula 4 or absent; in one particular embodiment, X$_{G31}$ is GPSSGAPPPS (SEQ ID NO:437) or PSSGAPPPS (SEQ ID NO:438), in which any one of the amino acid residues can be substituted or deleted or is a general formula 1, or general formula 2, or general formula 3, or general formula 4;

In the present invention, the structure of general formula 1 is

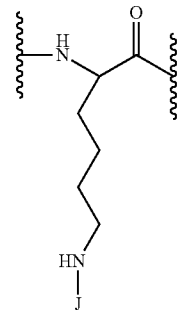

in which J is the structure of L$_n$-M$_L$, the structure of —W—X—Y—Z or a hydrogen atom;

M$_L$ is a modifying group, including, but not limited to, —W—X—Y—Z, a fatty acid, polyethylene glycol, albumin, IgG Fc, glycosyl, etc;

L$_n$ is a optional linking group, covalent linkage or absent; the optional linking group includes, but are not limited to, polyethylene glycol, a long chain fatty acid, a polypeptide, a natural or non-natural amino acid, or a long chain formed by linking one or more of polyethylene glycol molecules, fatty acids, polypeptides, amino acid molecules through covalent bonds. In one embodiment, L$_n$ may be a —NH—(CH$_2$CH$_2$O)$_n$—CH$_2$—CO—, —NH—(CH$_2$)$_n$—CO—, —NH—(CH$_2$CH$_2$O)$_n$—(CH$_2$)$_r$—CO—, n is an integer from 1 to 25, and r is an integer from 1 to 16. In one particular embodiment, L$_n$ is a —NH—(CH$_2$CH$_2$O)$_2$—CH$_2$—CONH—(CH$_2$CH$_2$O)$_2$—CH$_2$—CO—. In one embodiment, L$_n$ is a —NH—(CH$_2$)$_{n1}$—O—(CH$_2$CH$_2$O)$_{n2}$—(CH$_2$)$_{n3}$—CO—, n1, n2, and n3 are each an integer from 1 to 18. In one embodiment, $L_n$ is a —NH—$(CH_2)_{n1}$—$(OCH_2CH_2)_{n2}$—$\underline{C}O$—, n1 and n2 are each an integer from 1 to 18. In the above embodiments, $L_n$ is involved in formation of an amide bond between the carbon atom of the underlined carbonyl and an amino group on a side chain of a polypeptide, and the other terminus thereof forms a covalent linkage with $M_L$. In one embodiment, $L_n$ is involved in formation of an amide bond between the carbon atom of the underlined carbonyl and an amino group on a side chain of a polypeptide, and the other terminus thereof forms a covalent linkage with —W—X—Y—Z.

In the present invention, the structure of —W—X—Y—Z is

W is an α-amino acid residue having a carboxyl group in the side chain, this residue forms, with one of its carboxyl groups, an amide group together with the α-amino group of the N-terminal amino acid residue of the polypeptide/protein, or together with the ε-amino group of a Lys residue present in the polypeptide/protein, or together with the amino group at the end of $L_n$;

Or W is a chain composed of two, three or four α-amino acids linked together via amide bonds, this chain linked via an amide bond is linked to the α-amino group of the N-terminal amino acid residue of the polypeptide or protein, or to the ε-amino group of a Lys residue present in the polypeptide or protein, or to the amino group at the end of $L_n$, the amino acid residues of W being selected from the group of amino acid residues having a neutral side chain and/or amino acid residues having a carboxyl group in the side chain so that W has at least one amino acid residue which has a carboxyl group in the side chain; or Or W is a covalent bond from X to the α-amino group of the N-terminal amino acid residue of the polypeptide or protein, or to the ε-amino group of a Lys residue present in the polypeptide or protein, or to the amino group at the end of $L_n$;

X is —$\underline{C}O$—, —$CH(COOH)\underline{C}O$—, —$N(CH_2COOH)CH_2\underline{C}O$—, —$N(CH_2COOH)CH_2CON$—$(CH_2COOH)CH_2\underline{C}O$—, —$N(CH_2CH_2COOH)CH_2CH_2\underline{C}O$—, —$NHCH(COOH)(CH_2)_4NH\underline{C}O$—, —$N(CH_2CH_2COOH)CH_2CH_2CON(CH_2CH_2COOH)CH_2CH_2\underline{C}O$—, —$N(CH_2CH_2COOH)CH_2\underline{C}O$— or —$N$—$(CH_2COOH)CH_2CH_2\underline{C}O$—, wherein a) the above-mentioned X forms an amide bond with an amino group in W through the bond of the underlined carbonyl C, when W is an amino acid residue or a series of amino acid residues, or b) the above-mentioned X forms an amide bond with the α-amino group of an amino acid residue at the N-terminus of the polypeptide/protein, or the ε-amino group of a Lys residue in the polypeptide/protein, or the amino group at the end of $L_n$ through the bond of the underlined carbonyl C, when W is a covalent bond;

Y is —$(CH_2)m$, wherein m is an integer from 6 to 32; or a divalent hydrocarbon chain comprising 1, 2 or 3 of —CH=CH-groups and multiple of —$CH_2$— groups, wherein the number of —$CH_2$— groups allows the total number of carbon atoms in the chain to reach a range of 10 to 32;

or a divalent hydrocarbon chain of the general formula —$(CH_2)_vC_6H_4(CH_2)w$—, wherein v and w are integers or one of them is zero so that the sum of v and w is in the range of 6 to 30; and Z is —COOH; —CO-Asp; —CO-Glu; —CO-Gly; —CO-Sar; —$CH(COOH)_2$; —$N(CH_2COOH)_2$; —$SO_3H$; —$PO_3H$; or absent, provided that Z is not —COOH when W is a covalent bond and X is —CO—.

W in the side chain —W—X—Y—Z can be a covalent bond. Alternatively, W can be an α-amino acid residue having a carboxyl group in its side chain and comprising a total of from 4 to 10 carbon atoms. W also can be an α-amino acid residue encoded by a genetic code. For example, W can be selected from the group consisting of α-Asp, β-Asp, α-Glu, and γ-Glu. Further options for W are for example α-hGlu and δ-hGlu.

In a further embodiment, W is a chain composed of two α-amino acid residues of which one has from 4 to 10 carbon atoms and a carboxyl group in the side chain while the other has from 2 to 11 carbon atoms but no free carboxyl group. The α-amino acid residue with no free carboxyl group can be a neutral, encodable α-amino acid residue. Examples of W according to this embodiment are: α-Asp-Gly; Gly-α-Asp; β-Asp-Gly; Gly-β-Asp; α-Glu-Gly; Gly-α-Glu; γ-Glu-Gly; Gly-γ-Glu; α-hGlu-Gly; Gly-α-hGlu; δ-hGlu-Gly; and Gly-δ-hGlu.

In a further embodiment, W is a chain composed of two α-amino acid residues, independently having from 4 to 10 carbon atoms, and both having a carboxyl group in the side chain. One of these α-amino acid residues or both of them can be encodable α-amino acid residues. Examples of W according to this embodiment are: α-Asp-α-Asp; α-Asp-α-Glu; α-Asp-α-hGlu; α-Asp-β-Asp; α-Asp-γ-Glu; α-Asp-δ-hGlu; β-Asp-α-Asp; β-Asp-α-Glu; β-Asp-α-hGlu; β-Asp-β-Asp; β-Asp-γ-Glu; β-Asp-δ-hGlu; α-Glu-α-Asp; α-Glu-α-Glu; α-Glu-α-hGlu; α-Glu-β-Asp; α-Glu-γ-Glu; α-Glu-δ-hGlu; γ-Glu-α-Asp; γ-Glu-α-Glu; γ-Glu-α-hGlu; γ-Glu-β-Asp; γ-Glu-γ-Glu; γ-Glu-δ-hGlu; α-hGlu-α-Asp; α-hGlu-α-Glu; α-hGlu-α-hGlu; α-hGlu-β-Asp; α-hGlu-γ-Glu; α-hGlu-δ-hGlu; δ-hGlu-α-Asp; δ-hGlu-α-Glu; δ-hGlu-α-hGlu; δ-hGlu-β-Asp; δ-hGlu-γ-Glu; and δ-hGlu-δ-hGlu.

In a further embodiment, W is a chain composed of three α-amino acid residues, independently having from 4 to 10 carbon atoms, the amino acid residues of the chain being selected from the group of residues having a neutral side chain and residues having a carboxyl group in the side chain so that the chain has at least one residue which has a carboxyl group in the side chain. In one embodiment, the amino acid residues are encodable residues.

In a further embodiment, W is a chain composed of four α-amino acid residues, independently having from 4 to 10 carbon atoms, the amino acid residues of the chain being selected from the group of residues having a neutral side chain and residues having a carboxyl group in the side chain so that the chain has at least one residue which has a carboxyl group in the side chain. In one embodiment, the amino acid residues are encodable residues.

In one embodiment, W in —W—X—Y—Z can be connected to the ε-amino group of the Lys residue via a urea derivative.

The X of the side chain —W—X—Y—Z can be a group of the general formula —$\underline{C}O$—, which via a bond from the underlined carbonyl carbon, forms an amide bond with an amino group in W; or when W is a covalent bond, via a bond from the underlined carbonyl carbon, X forms an amide bond with the N-terminal α-amino group in the polypeptide/protein, or with the ε-amino group of a Lys residue present in the polypeptide/protein, or with amino group at the end of $L_n$.

In a further embodiment, the X of the side chain —W—X—Y—Z can be a group of the general formula —$CH(COOH)\underline{C}O$—, which via a bond from the underlined carbonyl carbon, forms an amide bond with an amino group in W or; or when W is a covalent bond, via a bond from the underlined carbonyl carbon, X forms an amide bond with the N-terminal α-amino group in the polypeptide/protein, or with the ε-amino group of a Lys residue present in the polypeptide/protein, or with amino group at the end of $L_n$.

In a further embodiment, the X of the side chain —W—X—Y—Z can be a group of the general formula —N(CH$_2$COOH)CH$_2$C̲O—, which via a bond from the underlined carbonyl carbon, forms an amide bond with an amino group in W or; or when W is a covalent bond, via a bond from the underlined carbonyl carbon, X forms an amide bond with the N-terminal α-amino group in the polypeptide/protein, or with the ε-amino group of a Lys residue present in the polypeptide/protein, or with amino group at the end of $L_n$.

In a further embodiment, the X of the side chain —W—X—Y—Z can be a group of the general formula —N(CH$_2$CH$_2$COOH)CH$_2$C̲O—, which via a bond from the underlined carbonyl carbon, forms an amide bond with an amino group in W or; or when W is a covalent bond, via a bond from the underlined carbonyl carbon, X forms an amide bond with the N-terminal α-amino group in the polypeptide/protein, or with the ε-amino group of a Lys residue present in the polypeptide/protein, or with amino group at the end of $L_n$.

In a further embodiment, the X of the side chain —W—X—Y—Z can be a group of the general formula —N(CH$_2$COOH)CH$_2$CH$_2$C̲O—, which via a bond from the underlined carbonyl carbon, forms an amide bond with an amino group in W or; or when W is a covalent bond, via a bond from the underlined carbonyl carbon, X forms an amide bond with the N-terminal α-amino group in the polypeptide/protein, or with the ε-amino group of a Lys residue present in the polypeptide/protein, or with amino group at the end of $L_n$.

In a further embodiment, the X of the side chain —W—X—Y—Z can be a group of the general formula —N(CH$_2$COOH) CH$_2$CON(CH$_2$COOH)CH$_2$C̲O—, which via a bond from the underlined carbonyl carbon, forms an amide bond with an amino group in W or; or when W is a covalent bond, via a bond from the underlined carbonyl carbon, X forms an amide bond with the N-terminal α-amino group in the polypeptide/protein, or with the ε-amino group of a Lys residue present in the polypeptide/protein, or with amino group at the end of $L_n$.

In a further embodiment, the X of the side chain —W—X—Y—Z can be a group of the general formula —N(CH$_2$CH$_2$COOH)CH$_2$CH$_2$C̲O—, which via a bond from the underlined carbonyl carbon, forms an amide bond with an amino group in W or; when W is a covalent bond, via a bond from the underlined carbonyl carbon, X forms an amide bond with the N-terminal α-amino group in the polypeptide/protein, or with the ε-amino group of a Lys residue present in the polypeptide/protein, or with amino group at the end of $L_n$.

In a further embodiment, the X of the side chain —W—X—Y—Z can be a group of the general formula —N(CH$_2$CH$_2$COOH) CH$_2$CH$_2$CO N(CH$_2$CH$_2$COOH)CH$_2$CH$_2$C̲O—, which via a bond from the underlined carbonyl carbon, forms an amide bond with an amino group in W or; or when W is a covalent bond, via a bond from the underlined carbonyl carbon, X forms an amide bond with the N-terminal α-amino group in the polypeptide/protein, or with the ε-amino group of a Lys residue present in the polypeptide/protein, or with amino group at the end of $L_n$.

The Y of the side chain —W—X—Y—Z can be a group of the general formula —(CH$_2$)$_m$—, where m is an integer in the range from 6 to 32, from 8 to 20, from 12 to 20, or from 12-16.

In another embodiment, Y of the side chain —W—X—Y—Z is a divalent hydrocarbon chain comprising 1, 2 or 3 —CH=CH-groups and a number of —CH$_2$— groups sufficient to give a total number of carbon atoms in the chain in the range of from 6 to 32, from 10 to 32, from 12 to 20, or from 12-16.

In another embodiment, Y of the side chain —W—X—Y—Z is a divalent hydrocarbon chain of the general formula —(CH$_2$)$_v$C$_6$H$_4$(CH$_2$)$_w$—, wherein v and w are integers or one of them is zero so that the sum of v and w is in the range of from 6 to 30, from 10 to 20, or from 12-16.

In one embodiment, the Z of the side chain —W—X—Y—Z is —COOH, provided that when W is a covalent bond and X is —CO—, then Z is not —COOH.

In another embodiment, the Z of the side chain —W—X—Y—Z is —CO-Asp, —CO-Glu, —CO-Gly, —CO-Sar, —CH(COOH)$_2$, —N(CH$_2$COOH)$_2$, —SO$_3$H or —PO$_3$H;

In a further embodiment, W of the side chain —W—X—Y—Z is selected from the group consisting of α-Asp, β-Asp, α-Glu, and γ-Glu; X is —CO— or —CH(COOH)CO; Y is —(CH$_2$)$_m$—, where m is an integer in the range of 12-18 and Z is —COOH, —CH(COOH)$_2$ or absent;

In a further embodiment, W of the side chain —W—X—Y—Z is selected from the group consisting of α-Asp, β-Asp, α-Glu or γ-Glu; —X—Y—Z is —C̲O(CH$_2$)$_n$CH$_3$, which via a bond from the underlined carbonyl carbon, forms an amide bond with an amino group in W; n is an integer in the range of 10-20.

In a further embodiment, W of the side chain —W—X—Y—Z is selected from the group consisting of α-Asp, β-Asp, α-Glu or γ-Glu; —X—Y—Z is —CO(CH$_2$)$_{12}$CH$_3$.

In a further embodiment, W of the side chain —W—X—Y—Z is selected from the group consisting of α-Asp, β-Asp, α-Glu or γ-Glu; —X—Y—Z is —CO(CH$_2$)$_{14}$CH$_3$.

In a further embodiment, W of the side chain —W—X—Y—Z is selected from the group consisting of α-Asp, β-Asp, α-Glu or γ-Glu; —X—Y—Z is —CO(CH$_2$)$_{16}$CH$_3$.

In the present invention, the structure of general formula 2 is

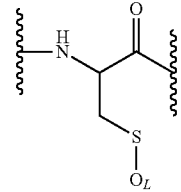

wherein the basic structure of $O_L$ is $M_r$-$L_r$-NH-J, $M_r$-$L_r$-$Z_r$, $M_r$-$L_r$-$M_r$, $M_r$-$L_r$-$M_L$, or a hydrogen atom;

J and $M_L$ are defined as the above in the present invention;

$M_r$ is a functional group capable of reacting with the mercapto group to form a covalent linkage, for example, maleimide, vinylsulfone, iodoacetyl, etc.; $L_r$ is an alternative linking group, covalent linkage or absent, including, but not limited to, polyethylene glycol, a long chain fatty acid, or a long chain formed by linking together one or more polyethylene glycol molecules and long chain fatty acid molecules through covalent bonds.

The two $M_r$ at ends of $L_r$ in $M_r$-$L_r$-$M_r$ can be identical or different; a covalent linkage is formed after $M_r$ at one end of $M_r$-$L_r$-$M_r$ is reacted with an IL-1ra.

When $M_L$ is an immunoglobulin or IgG Fc, one end of the linking group is $M_r$ and linked to the IL-1ra while the other end is an aldehyde group which is reacted with the amino group on an immunoglobulin or the Fc of an IgG through reductive amination to form a covalent linkage. $M_L$ includes part of or the whole of constant regions of the heavy or light chain of a human immunoglobulin. The immunoglobulin portion may include all constant regions except the first domain in the heavy chain constant regions of a human immunoglobulin (e.g., IgG, IgA, IgM, or IgE). Any amino acid residue in each of the immunoglobulin portions can be deleted or substituted with one or more of amino acid residues, or can be inserted with one or more of amino acid residues.

$O_L$ includes, but is not limited to the following structure:

—$\underline{C}H_2$—CONH—$(CH_2)_n$—NH-J, a thioether bond is formed by a bond from the underlined carbon atom and the sulphur atom of a cysteine;

—$\underline{C}H_2$—CONH—$(CH_2)_n$—$Z_1$, a thioether bond is formed by a bond from the underlined carbon atom and the sulphur atom of a cysteine;

—$\underline{C}H_2$—CONH—$(CH_2CH_2O)_n$—$(CH_2)_m$—NH-J, a thioether bond is formed by a bond from the underlined carbon atom and the sulphur atom of a cysteine;

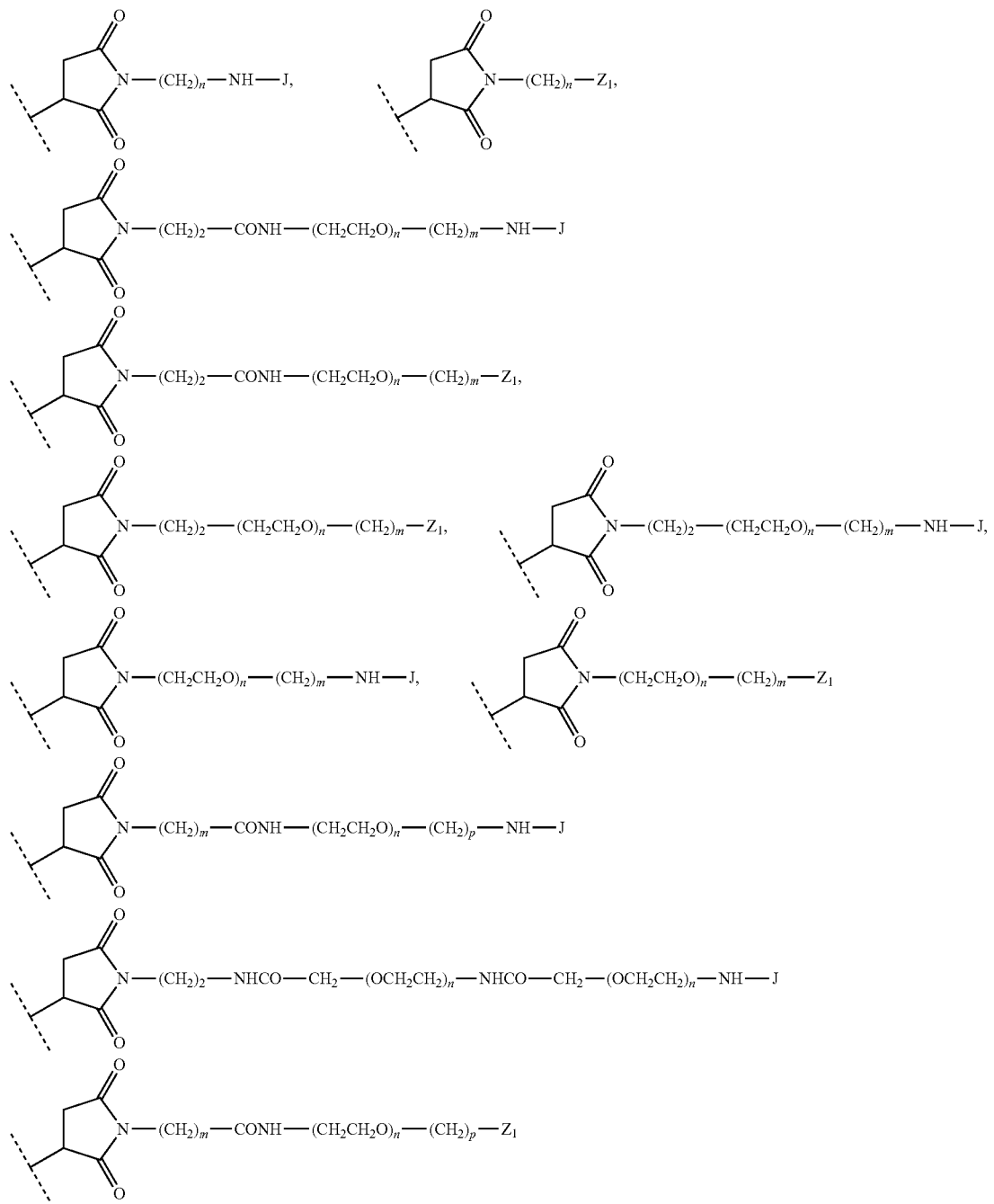

—CH$_2$—CONH—(CH$_2$CH$_2$O)$_n$—(CH$_2$)$_m$—Z$_1$, a thioether bond is formed by a bond from the underlined carbon atom and the sulphur atom of a cysteine;

—CH$_2$—CH$_2$—SO$_2$—(CH$_2$CH$_2$O)$_n$—(CH$_2$)$_m$—NH-J, a thioether bond is formed by a bond from the underlined carbon atom and the sulphur atom of a cysteine;

—CH$_2$—CH$_2$—SO$_2$—(CH$_2$CH$_2$O)$_n$—(CH$_2$)$_m$—Z$_1$, a thioether bond is formed by a bond from the underlined carbon atom and the sulphur atom of a cysteine;

in which Z$_1$ is —COOH, —CO-Asp, —CO-Glu, —CO-Gly, —CO-Sar, —CH(COOH)$_2$, —N(CH$_2$COOH)$_2$, SO$_3$H, —PO$_3$H or absent; m, n, and p are each an integer from 1 to 25.

In the present invention, the structure of general formula 3 is

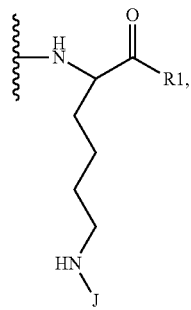

wherein J and O$_L$ are defined as the above and R$_1$ is —OH or —NH$_2$;

In the present invention, the structure of general formula 4 is

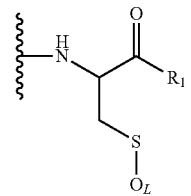

wherein R$_1$ and O$_L$ are defined as the above.

In one embodiment, the sequence of the GLP-1 receptor binding polypeptide is (SEQ ID NO: 232)
HX$_{G2}$EGTFTSDX$_{G10}$SSYLEX$_{G16}$QAAX$_{G20}$EFIAWLVX$_{G28}$GRX$_{G31}$, in which each of the variables is defined as the above.

In one embodiment, the sequence of the GLP-1 receptor binding polypeptide on the basis of exendin-4 is (SEQ ID NO: 233)
X$_{E1}$X$_{E2}$X$_{E3}$GTX$_{E6}$TSDX$_{E10}$SX$_{E12}$X$_{E13}$X$_{E14}$EX$_{E16}$X$_{E17}$AX$_{E19}$ X$_{E20}$X$_{E21}$FX$_{E23}$X$_{E24}$X$_{E25}$LX$_{E27}$X$_{E28}$X$_{E29}$X$_{E30}$X$_{E31}$X$_{E32}$X$_{E33}$

X$_{E34}$X$_{E35}$X$_{E36}$X$_{E37}$X$_{E38}$X$_{E39}$, wherein

X$_{E1}$ is a histidine, D-histidine, deamino-histidine, β-hydroxyl-histidine, homohistidine, α-fluoromethyl-histidine, α-methyl-histidine, N-methyl-histidine, N$^\alpha$-acetyl-histidine, α-methyl-histidine, 2-pyridinyl-alanine, 3-pyridinyl-alanine, 4-pyridinyl-alanine, imidazopropionyl, arginine, or tyrosine; X$_{E2}$ is a glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid, aminocyclohexanecarboxylic acid, aminocycloheptanecarboxylic acid, or aminocyclooctanecarboxylic acid; X$_{E3}$ is an aspartic acid, glutamic acid, or glutamine; X$_{E6}$ is a phenylalanine, alanine, tyrosine, or naphthylalanine; X$_{E10}$ is a leucine, isoleucine, tyrosine, valine, alanine, lysine, cysteine, general formula 1, general formula 2, or pentaglycine; X$_{E12}$ is a lysine, cysteine, arginine, serine, isoleucine, or general formula 1, or general formula 2; X$_{E13}$ is a glutamine, alanine, or tyrosine; X$_{E14}$ is a methionine, leucine, norleucine, isoleucine, alanine, valine, or general formula 1, or general formula 2; X$_{E16}$ is a glutamic acid, aspartic acid, serine, glycine, lysine, or arginine; X$_{E17}$ is a glutamic acid, glutamine, arginine, or isoleucine; X$_{E19}$ is a valine, alanine, or glutamine; X$_{E20}$ is a lysine, glutamine, cysteine, arginine, general formula 1, or general formula 2; X$_{E21}$ is a leucine, glutamic acid, or aspartic acid; X$_{E23}$ is an isoleucine, leucine, valine, pentaglycine; X$_{E24}$ is an alanine, glutamic acid, aspartic acid, asparagine, or glutamine; X$_{E25}$ is an alanine, tryptophan, phenylalanine, tyrosine, cysteine, lysine, naphthylalanine, general formula 1, or general formula 2; X$_{E27}$ is a lysine, cysteine, asparagine, leucine, valine, arginine, general formula 1, or general formula 2; X$_{E28}$ is an asparagine, lysine, cysteine, arginine, alanine, general formula 1, or general formula 2; X$_{E29}$ is —NH$_2$, glycine, glutamine, threonine, lysine, cysteine, or absent; X$_{E30}$ is —NH$_2$, glycine, tyrosine, arginine, lysine, cysteine, general formula 1, general formula 2, or absent; X$_{E31}$ is —NH$_2$, glycine, proline, homoproline, thioproline, N-alkyl alanine, or absent; X$_{E32}$ is a serine, lysine, cysteine, deletion, general formula 1, or general formula 2; X$_{E33}$ is a serine, lysine, cysteine, general formula 1, general formula 2, or absent; X$_{E34}$ is a glycine, absent, general formula 1, or general formula 2; X$_{E35}$ is an alanine, lysine, cysteine, general formula 1, general formula 2, or absent; X$_{E36}$ is a proline, homoproline, thioproline, N-alkyl alanine, or absent; X$_{E37}$ is a proline, homoproline, thioproline, N-alkyl alanine, or absent; X$_{E38}$ is a proline, homoproline, thioproline, N-alkylalanine, or absent; X$_{E39}$ is a serine, serine-NH$_2$, cysteine, cysteine-NH$_2$, lysine, lysine-NH$_2$, or absent, or is a linking or spacer group +X$_{E40}$, wherein X$_{E40}$ is a lysine, cysteine, general formula 3, or general formula 4.

In one embodiment, the sequence of the GLP-1 receptor binding polypeptide on the basis of exendin-4 is (SEQ ID NO: 234)
X$_{E1}$GEGTFTSDLSX$_{E12}$QX$_{E14}$EEEAVX$_{E20}$LFIEWLX$_{E27}$X$_{E28}$X$_{E29}$ X$_{E30}$X$_{E31}$X$_{E32}$X$_{E33}$X$_{E34}$X$_{E35}$X$_{E36}$X$_{E37}$X$_{E38}$X$_{E39}$, wherein each of the variables is defined as the above.

In one embodiment, compared with the wild-type sequence, the amino acid sequence of an exendin-4 analogue have one or more amino acid residues substituted with a cysteine or lysine residue, for example, the C-terminal, the arginine at position 20, the tryptophan at position 25, the glycine at position 30, the alanine at position 35, and the serine at position 39 or the residues at other sites can be substituted with a cysteine or lysine residue.

From the above description, it can be seen that the GLP-1 receptor binding polypeptide and the interleukin-1 receptor antagonistic protein are able to protect P cells in the pancreas islet by similar or distinct mechanisms, thereby treating diabetes. Accordingly, the fusion protein, dimeric protein, cross-linking protein formed by connecting the two polypeptides may attain a therapeutic effect more excellent than that with either of the polypeptides alone, due to the synergism of the two polypeptides. Furthermore, one of the organs in which the GLP-1 receptors are mainly distributed is the pancreatic islet. The GLP-1 receptor binding polypeptide can serve as a guider for the fusion protein and enrich the interleukin-1 receptor antagonistic protein within and around the pancreatic islet, more effectively exerting actions such as anti-inflammation, etc.

The GLP-1 receptor binding polypeptide is linked to the interleukin-1 receptor antagonistic protein in various linkages through an alternative linking group (or spacer group).

(1) GLP-1 receptor binding polypeptide—linking group or spacer group—the interleukin-1 receptor antagonistic protein fusion protein.

In one embodiment, the GLP-1 receptor binding polypeptide and the interleukin-1 receptor antagonistic protein form a single chain compound via a linking group, of which the structure is (from left to right corresponding to the amino acid sequence from N-terminus to C-terminus):

the GLP-1 receptor binding polypeptide—linking group (or spacer group)-interleukin-1 receptor antagonistic protein; or the interleukin-1 receptor antagonistic protein-linking group (or spacer group)—the GLP-1 receptor binding polypeptide.

In one embodiment, the sequence of the fusion protein on the basis of exendin-4 and the interleukin-1 receptor antagonistic protein is (SEQ ID NO: 235)
$X_{E1}X_{E2}X_{E3}GTX_{E6}TSDX_{E10}SX_{E12}X_{E13}X_{E14}EX_{E16}X_{E17}AX_{E19}$ $X_{E20}X_{E21}FX_{E23}X_{E24}X_{E25}LX_{E27}X_{E28}X_{E29}X_{E30}X_{E31}X_{E32}X_{E33}$ $X_{E34}X_{E35}X_{E36}X_{E37}X_{E38}X_{E39}-L_j-X_{IL0}RPSGRKSSKMQAFRIWDV$

NQKTFYLRNNQLVAGYLQGPNVNLEEKIDVVPIEPHALFLGIHGGKM $X_{IL66}LSX_{IL69}VKSGDETRLQLEAVX_{IL84}ITDLSENRKQDKRFAFIRS$

DSGPTTSFESAAX$_{IL116}$PGWFLX$_{IL122}$TAMEADQPVSLTNMPDEGVMV

TKFYFQEDE, wherein each of the variables is defined as the above.

In one embodiment, the sequence of the fusion protein on the basis of exendin-4 and the interleukin-1 receptor antagonistic protein is (SEQ ID NO: 236)
$X_{E1}X_{E2}EGTFTSDX_{E10}SX_{E12}QX_{E14}EEEAVX_{E20}LFIEWLX_{E27}X_{E28}$ $X_{E29}X_{E30}X_{E31}X_{E32}X_{E33}X_{E34}X_{E35}X_{E36}X_{E37}X_{E38}X_{E39}-L_j-$ $X_{IL0}$RPSGRKSSKNIQAFRIWDVNQKTFYLRNNQLVAGYLQGPNVNLEEK

IDVVPIEPHALFLGIHGGKNIX$_{IL66}$LSX$_{IL69}$VKSGDETRLQLEAV $X_{IL84}$ITDLSENRKQDKRFAFIRSDSGPTTSFESAAX$_{IL116}$PGWFL $X_{IL122}$TAMEADQPVSLTNMPDEGVMVTKFYFQEDE, wherein each of the variables is defined as the above.

In one embodiment, the sequence of the fusion protein on the basis of exendin-4 and the interleukin-1 receptor antagonistic protein is (SEQ ID NO: 237)
HX$_{E2}$EGTFTSDX$_{E10}$SX$_{E12}$QX$_{E14}$EEEAVX$_{E20}$LFIEWLX$_{E27}$X$_{E28}$ $X_{E29}X_{E30}(PX_{E32}X_{E33}GX_{E35}PPPX_{E39})_{t2}-L_j-X_{IL0}$RPSGRKSSK

MQAFRIWDVNQKTFYLRNNQLVAGYLQGPNVNLEEKIDVVPIEPHALFLG

IHGGKMCLSCVKSGDETRLQLEAVX$_{IL84}$ITDLSENRKQDKRFAFIRSDS

GPTTSFESAAX$_{IL116}$PGWFLCTAMEADQPVSLTNMPDEGVMVTKFYFQE

DE, wherein t2 is 0 or 1 and other variables are defined as the above.

In one embodiment, the sequence of the fusion protein on the basis of exendin-4 and the interleukin-1 receptor antagonistic protein is (SEQ ID NO: 238)
HX$_{E2}$EGTFTSDX$_{E10}$SX$_{E12}$QX$_{E14}$EEEAVX$_{E20}$LFIEWLX$_{E27}$X$_{E28}$ $X_{E29}X_{E30}(PX_{E32}X_{E33}GX_{E35}PPPX_{E39})_{t2}-(GGGGS)_m-X_L-$ $(GGGGS)_n-X_{IL0}$RPSGRKSSKNIQAFRIWDVNQKTFYLRNNQLVAGYLQ

GPNVNLEEKIDVVPIEPHALFLGIHGGKMCLSCVKSGDETRLQLEAV $X_{IL84}$ITDLSENRKQDKRFAFIRSDSGPTTSFESAAX$_{IL116}$PGWFLCTA

MEADQPVSLTNMPDEGVMVTKFYFQEDE, wherein m and n are each 0, 1, 2, 3, 4, 5, or 6; $X_L$ is a cysteine, lysine, absent, general formula 1 or general formula 2; t2 is 0 or 1; and other variables are defined as the above.

In one embodiment, the sequence of the fusion protein is (SEQ ID NO: 239)
HGEGTFTSDLSX$_{E12}$QMEEEAVRLFIEWLX$_{E27}$NGGPSSGAPPPS- $(GGGGS)_m-X_L-(GGGGS)_n-X_{IL0}$RPSGRKSSKMQAFRIWDVNQKTFYL

RNNQLVAGYLQGPNVNLEEKIDVVPIEPHALFLGIHGGKMCLSCVKSGDE

TRLQLEAVNITDLSENRKQDKRFAFIRSDSGPTTSFESAAX$_{IL116}$PGWF

LCTAMEADQPVSLTNMPDEGVMVTKFYFQEDE, in which m and n are each 0, 1, 2, 3, 4, 5, or 6 and other variables are defined as the above.

In one embodiment, the sequence of the fusion protein is (SEQ ID NO: 240)
HGEGTFTSDLSX$_{E12}$QMEEEAVRLFIEWLX$_{E27}$NGGPSSGAPPPX$_{E39}$-

$(GGGGS)_n-X_{IL0}$RPSGRKSSKMQAPRIWDVNQKTFYLRNNQLVAGYLQG

PNVNLEEKIDVVPIEPHALFLGIHGGKMCLSCVKSGDETRLQLEAVNITD

LSENRKQDKRFAFIRSDSGPTTSPESAAX$_{IL116}$PGWFLCTAMEADQPVS

LTNMPDEGVMVTKFYFQEDE, in which n is 0, 1, 2, 3, 4, 5, or 6 and other variables are defined as the above.

In one embodiment, the sequence of the fusion protein is (SEQ ID NO: 241)
HGEGTFTSDLSKQMEEEAVRLFIEWLKNGGPSSGAPPPS-(GGGGS)$_n$-X$_{IL0}$RPSGRKSSKMQAFRIWDVNQKTFYLRNNQLVAGYLQGPNVNLEEK IDVVPIEPHALFLGIHGGKMCLSCVKSGDETRLQLEAVNITDLSENRKQ DKRFAFIRSDSGPTTSFESAAC($\underline{S}$-O$_L$)PGWFLCTAMEADQPVSLTNMP DEGVMVTKFYFQEDE($\underline{S}$ is the sulphur atom on the side chain of a cysteine residue), wherein
n is 0, 1, 2, 3, 4, 5, or 6 and other variables are defined as the above.

In one embodiment, the sequence of the fusion protein is (SEQ ID NO: 242)
HGEGTFTSDLSKQMEEEAVRLFIEWLKNGGPSSGAPPPS-(GGGGS)$_n$-X$_{IL0}$RPSGRKSSKMQAFRIWDVNQKTFYLRNNQLVAGYLQGPNVNLEEK IDVVPIEPHALFLGIHGGKMCLSCVKSGDETRLQLEAVC ($\underline{S}$-O$_L$) IT DLSENRKQDKRFAFIRSDSGPTTSFESAASPGWFLCTAME ADQPVSLT NMPDEGVMVTKFYFQEDE ($\underline{S}$ is the sulphur atom on the side chain of a cysteine residue), in which
n is 0, 1, 2, 3, 4, 5, or 6 and other variables are defined as the above.

In one embodiment, the sequence of the fusion protein on the basis of GLP-1 and the interleukin receptor antagonistic protein is (SEQ ID NO: 243)
X$_{G1}$X$_{G2}$X$_{G3}$GX$_{G5}$X$_{G6}$TSDX$_{G10}$SX$_{G12}$YLEX$_{G16}$X$_{G17}$X$_{G18}$AX$_{G20}$ X$_{G21}$FIX$_{G24}$X$_{G25}$LX$_{G27}$X$_{G28}$X$_{G29}$X$_{G30}$X$_{G31}$-L$_j$-X$_{IL0}$RPSGRKS SKMQAFRIWDVNQKTFYLRNNQLVAGYLQGPNVNLEEKIDVVPIEPHALF LGIHGGKMX$_{IL66}$LSX$_{IL69}$VKSGDETRLQLEAVX$_{IL84}$ITDLSENRKQD KRFAFIRSDSGPTTSFESAAX$_{IL116}$PGWFLX$_{IL122}$TAMEADQPVSLTN MPDEGVMVTKFYFQEDE;

in which each of the variables is defined as the above.

In one embodiment, the sequence of the fusion protein is (SEQ ID NO: 244)
HX$_{G2}$EGTFTSDX$_{G10}$SX$_{G12}$YLEX$_{G16}$QAAX$_{G20}$EFIAWLVX$_{G28}$GR X$_{G31}$-L$_j$-X$_{IL0}$RPSGRKSSKMQAFRIWDVNQKTFYLRNNQLVAGYLQGP NVNLEEKIDVVPIEPHALFLGIHGGKMCLSCVKSGDETRLQLEAVX$_{IL84}$ ITDLSENRKQDKRFAFIRSDSGPTTSFESAAX$_{IL116}$PGWFLCTAMEADQ PVSLTNMPDEGVMVTKFYFQEDE, in which each of the variables is defined as the above.

In one embodiment, the sequence of the fusion protein is (SEQ ID NO: 245)
HX$_{G2}$EGTFTSDX$_{G10}$SX$_{G12}$YLEX$_{G16}$QAAX$_{G20}$EFIAWLVX$_{G28}$GR X$_{G31}$-(GGGGS)$_m$-X$_L$-(GGGGS)$_n$-X$_{IL0}$RPSGRKSSKMQAFRIWDVNQ KTFYLRNNQLVAGYLQGPNVNLEEKIDVVPIEPHALFLGIHGGKMCLSCV KSGDETRLQLEAVX$_{IL84}$ITDLSENRKQDKRFAFIRSDSGPTTSFESAA X$_{IL116}$PGWFLCTAMEADQPVSLTNMPDEGVMVTKFYFQEDE;

in which m and n are each 0, 1, 2, 3, 4, 5, or 6 and other variables are defined as the above.

In one embodiment, the sequence of the fusion protein is (SEQ ID NO: 246)
HX$_{G2}$EGTFTSDX$_{G10}$SSYLEX$_{G16}$QAAX$_{G20}$EFIAWLVX$_{G28}$GRG- (GGGGS)$_m$-X$_L$-(GGGGS)$_n$-X$_{IL0}$RPSGRKSSKMQAFRIWDVNQKTFYL RNNQLVAGYLQGPNVNLEEKIDVVPIEPHALFLGIHGGKMCLSCVKSGDE TRLQLEAVNITDLSENRKQDKRFAFIRSDSGPTTSFESAAX$_{IL116}$PGWF LCTAMEADQPVSLTNMPDEGVMVTKFYFQEDE, in which m and n are each 0, 1, 2, 3, 4, 5, or 6 and other variables are defined as the above.

In one embodiment, the sequence of the fusion protein is (SEQ ID NO: 247)
HX$_{G2}$EGTFTSDX$_{G10}$SSYLEX$_{G16}$QAAX$_{G20}$EFIAWLVX$_{G28}$GRX$_{G31}$- (GGGGS)$_n$-X$_{IL0}$RPSGRKSSKMQAFRIWDVNQKTFYLRNNQLVAGYLQ GPNVNLEEKIDVVPIEPHALFLGIHGGKMCLSCVKSGDETRLQLEAVNI TDLSENRKQDKRFAFIRSDSGPTTSFESAAX$_{IL116}$PGWFLCTAMEADQ PVSLTNMPDEGVMVTKFYFQEDE, in which n is 0, 1, 2, 3, 4, 5, or 6 and other variables are defined as the above.

(SEQ ID NO: 248)
HX$_{G2}$EGTFTSDVSSYLEX$_{G16}$QAAKEFIAWLVKGRG-(GGGGS)$_n$-X$_{IL0}$ RPSGRKSSKMQAFRIWDVNQKTFYLRNNQLVAGYLQGPNVNLEEKIDVVP IEPHALFLGIHGGKMCLSCVKSGDETRLQLEAVNITDLSENRKQDKRFAF IRSDSGPTTSFESAAC($\underline{S}$-O$_L$)PGWFLCTAMEADQPVSLTNMPDEGVMVT KFYFQEDE ($\underline{S}$ is the sulphur atom on the side chain of a cysteine residue), wherein n is 0, 1, 2, 3, 4, 5, or 6 and other variables are defined as the above.

In one embodiment, the sequence of the fusion protein is (SEQ ID NO: 249)
HX$_{G2}$EGTFTSDVSSYLEX$_{G16}$QAAKEFIAWLVKGRG-(GGGGS)$_n$-X$_{IL0}$ RPSGRKSSKMQAFRIWDVNQKTFYLRNNQLVAGYLQGPNVNLEEKIDVVP IEPHALFLGIHGGKMCLSCVKSGDETRLQLEAVC($\underline{S}$-O$_L$)ITDLSENRKQ DKRFAFIRSDSGPTTSFESAASPGWFLCTAMEADQPVSLTNMPDEGVMVT KFYFQEDE(S is the sulphur atom on the side chain of a cysteine residue), wherein n is 0, 1, 2, 3, 4, 5, or 6 and other variables are defined as the above.

In one embodiment, the sequence of the fusion protein is (SEQ ID NO: 250)
HX$_{G2}$EGTFTSDX$_{G10}$SSYLEX$_{G16}$QAAX$_{G20}$EFIAWLVX$_{G28}$GRPSSGAP PPS-(GGGGS)$_m$-X$_L$-(GGGGS)$_n$-X$_{IL0}$RPSGRKSSKMQAFRIWDVNQK

TFYLRNNQLVAGYLQGPNVNLEEKIDVVPIEPHALFLGIHGGKMCLSCVK

SGDETRLQLEAVNITDLSENRKQDKRFAFIRSDSGPTTSFESAAX$_{IL116}$

CPGWFLCTAMEADQPVSLTNMPDEGVMVTKFYFQEDE, wherein m and n are each 0, 1, 2, 3, 4, 5, or 6; X$_L$ is a cysteine, lysine or absent, or is general formula 1 or general formula 2; and other variables are defined as the above.

In one embodiment, the sequence of the fusion protein is (SEQ ID NO: 251)
HX$_{G2}$EGTFTSDX$_{G10}$SSYLEX$_{G16}$QAAX$_{G20}$EFIAWLVX$_{G28}$GRPSSGAP PPX$_{G39}$-(GGGGS)$_n$-X$_{IL0}$RPSGRKSSKMQAFRIWDVNQKTFYLRNNQL

VAGYLQGPNVNLEEKIDVVPIEPHALFLGIHGGKMCLSCVKSGDETRLQL

EAVNITDLSENRKQDKRFAFIRSDSGPTTSFESAAX$_{IL116}$PGWFLCTAM

EADQPVSLTNMPDEGVMVTKFYFQEDE, in which n is 0, 1, 2, 3, 4, 5, or 6 and other variables are defined as the above.

In one embodiment, the sequence of the fusion protein is (SEQ ID NO: 252)
HX$_{G2}$EGTFTSDVSSYLEX$_{G16}$QAAKEFIAWLVKGRPSSGAPPPS- (GGGGS)$_n$-X$_{IL0}$RPSGRKSSKMQAFRIWDVNQKTFYLRNNQLVAGYLQG

PNVNLEEKIDVVPIEPHALFLGIHGGKMCLSCVKSGDETRLQLEAVNITD

LSENRKQDKRFAFIRSDSGPTTSFESAAC(S-O$_L$)PGWFLCTAMEADQPV

SLTNMPDEGVMVTKFYFQEDE(S is the sulphur atom on the/ side chain of a cysteine residue), wherein n is 0, 1, 2, 3, 4, 5, or 6 and other variables are defined as the above.

In one embodiment, the sequence of the fusion protein is (SEQ ID NO: 253)
HX$_{G2}$EGTFTSDVSSYLEX$_{G16}$QAAKEFIAWLVKGRPSSGAPPPS- (GGGGS)$_n$-X$_{IL0}$RPSGRKSSKMQAFRIWDVNQKTFYLRNNQLVAGYLQG

PNVNLEEKIDVVPIEPHALFLGIHGGKMCLSCVKSGDETRLQLEAVC(S-

O$_L$)ITDLSENRKQDKRFAFIRSDSGPTTSFESAASPGWFLCTAMEADQPV

SLTNMPDEGVMVTKFYFQEDE(S is the sulphur atom on the side chain of a cysteine residue), wherein n is 0, 1, 2, 3, 4, 5, or 6 and other variables are defined as the above.

In one embodiment, the GLP-1 receptor binding polypeptide, the interleukin-1 receptor antagonistic protein, and a biomacromolecule form a single chain compound, for which the structure is (from left to right corresponding to the amino acid sequence from N-terminus to C-terminus):

GLP-1 receptor binding polypeptide—linking group (or spacer group)-biomacromolecule-linking group (or spacer group)-interleukin-1 receptor antagonistic protein;

GLP-1 receptor binding polypeptide—linking group (or spacer group)-interleukin-1 receptor antagonistic protein-linking group (or spacer group)-biomacromolecule; in which the biomacromolecule may be an albumin or IgG Fc, etc.

In one embodiment, the sequence of the fusion protein comprising the human albumin is:

(SEQ ID NO: 254)
HGEGTFTSDLSKQMEEEAVRLFIEWLKNGGPSSGAPPPS-(GGGGS)$_m$-D

AHKSEVAHRFKDLGEENFKALVLIAFAQYLQQCPFEDHVKLVNEVTEFAK

TCVADESAENCDKSLHTLFGDKLCTVATLRETYGEMADCCAKQEPERNEC

FLQHKDDNPNLPRLVRPEVDVMCTAFHDNEETFLKKYLYEIARRHPYFYA

PELLFFAKRYKAAFTECCQAADKAACLLPKLDELRDEGKASSAKQRLKCA

SLQKFGERAFKAWAVARLSQRFPKAEFAEVSKLVTDLTKVHTECCHGDLL

ECADDRADLAKYICENQDSISSKLKECCEKPLLEKSHCIAEVENDEMPAD

LPSLAADFVESKDVCKNYAEAKDVFLGMFLYEYARRHPDYSVVLLLRLAK

TYETTLEKCCAAADPHECYAKVFDEFKPLVEEPQNLIKQNCELFEQLGEY

KFQNALLVRYTKKVPQVSTPTLVEVSRNLGKVGSKCCKHPEAKRMPCAED

YLSVVLNQLCVLHEKTPVSDRVTKCCTESLVNRRPCFSALEVDETYVPKE

FNAETFTFHADICTLSEKERQIKKQTALVELVKHKPKATKEQLKAVMDDF

AAFVEKCCKADDKETCFAEEGKKLVAASQAALGL-(GGGGS)$_n$-X$_{IL0}$RP

SGRKSSKMQAFRIWDVNQKTFYLRNNQLVAGYLQGPNVNLEEKIDVVPIE

PHALFLGIHGGKMCLSCVKSGDETRLQLEAVNITDLSENRKQDKRFAFIR

SDSGPTTSFESAACPGWFLCTAMEADQPVSLTNMPDEGVMVTKFYFQED

E, in which m and n are each 0, 1, 2, 3, 4, 5, or 6 and other variables are defined as the above.

In one embodiment, the sequence of the fusion protein with the human albumin is:

(SEQ ID NO: 255)
HGEGTFTSDLSKQMEEEAVRLFIEWLKNGGPSSGAPPPS-(GGGGS)$_m$-

X$_{IL0}$RPSGRKSSKMQAFRIWDVNQKTFYLRNNQLVAGYLQGPNVNLEEKI

DVVPIEPHALFLGIHGGKMCLSCVKSGDETRLQLEAVNITDLSENRKQDK

RFAFIRSDSGPTTSFESAACPGWFLCTAMEADQPVSLTNMPDEGVMVTKF

YFQEDE-(GGGGS)$_n$-DAHKSEVAHRFKDLGEENFKALVLIAFAQYLQQC

PFEDHVKLVNEVTEFAKTCVADESAENCDKSLHTLFGDKLCTVATLRETY

GEMADCCAKQEPERNECFLQHKDDNPNLPRLVRPEVDVMCTAFHDNEETF

LKKYLYEIARRHPYFYAPELLFFAKRYKAAFTECCQAADKAACLLPKLDE

LRDEGKASSAKQRLKCASLQKFGERAFKAWAVARLSQRFPKAEFAEVSKL

VTDLTKVHTECCHGDLLECADDRADLAKYICENQDSISSKLKECCEKPLL

-continued

EKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL, in which m and n are each 0, 1, 2, 3, 4, 5, or 6 and other variables are defined as the above.

In one embodiment, the sequence of the fusion protein with the human albumin is:

(SEQ ID NO: 256)
HX$_{G2}$EGTFTSDVSSYLEX$_{G16}$QAAKEFIAWLVKGRG-(GGGGS)$_m$-DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL-(GGGGS)$_n$-X$_{IL0}$RPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE, wherein m and n are each 0, 1, 2, 3, 4, 5, or 6 and other variables are defined as the above.

In one embodiment, the sequence of the fusion protein with the human albumin is:

(SEQ ID NO: 257)
HX$_{G2}$EGTFTSDVSSYLEX$_{G16}$QAAKEFIAWLVKGRG-(GGGGS)$_m$-X$_{IL0}$RPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE-(GGGGS)$_n$-DAHKSEVAHRFKDLGEENFKALVLIAFAQYLQQCPPEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLHAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELPEQLGEYKFQNALLVRYTKKVPQVSTPTLVEVSRNLGKVGSKCCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL, and other variables are defined as the above.

In one embodiment, the sequence of the fusion protein with the human albumin is:

(SEQ ID NO: 258)
HX$_{G2}$EGTFTSDVSSYLEX$_{G16}$QAAKEFIAWLVKGRHX$_{G2}$EGTFTSDVSSYLEX$_{G16}$QAAKEFIAWLVKGR-(GGGGS)$_m$-RPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE-(GGGGS)$_n$-DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLHAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL, wherein m and n are each 0, 1, 2, 3, 4, 5, or 6 and other variables are defined as the above.

In one embodiment, the sequence of the fusion protein with the human albumin is:

(SEQ ID NO: 259)
HX$_{G2}$EGTFTSDVSSYLEX$_{G16}$QAAKEFIAWLVKGRHX$_{G2}$EGTFTSDVSSYLEX$_{G16}$QAAKEFIAWLVKGR-(GGGGS)$_m$-DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVST

-continued

PTLVEVSRNLGKVGSKCCKHPEAKRMPCAEDYLSVVLNQLCVLHEKTPVS

DRVTKCCTESLVNRRPCFSALEVDETYVPKEFNAETFTFHADICTLSEKE

RQIKKQTALVELVKHKPKATKEQLKAVMDDFAAFVEKCCKADDKETCFAE

EGKKLVAASQAALGL-(GGGGS)$_n$-RPSGRKSSKMQAFRIWDVNQKTFYL

RNNQLVAGYLQGPNVNLEEKIDVVPIEPHALFLGIHGGKMCLSCVKSGDE

TRLQLEAVNITDLSENRKQDKRFAFIRSDSGPTTSFESAACPGWFLCTAM

EADQPVSLTNMPDEGVMVTKFYFQEDE;

wherein m and n are each 0, 1, 2, 3, 4, 5, or 6 and other variables are defined as the above.

In one embodiment, the sequence of the fusion protein with the human albumin is:

(SEQ ID NO: 260)
HGEGTFTSDLSKQMEEEAVRLFIEWLKNGG(PSSGAPPPS)$_{t2}$HGEGTFT

SDLSKQMEEEAVRLFIEWLKNGG(PSSGAPPPS)$_{t2}$-(GGGGS)$_m$-RPSG

RKSSKMQAFRIWDVNQKTFYLRNNQLVAGYLQGPNVNLEEKIDVVPIEPH

ALFLGIHGGKMCLSCVKSGDETRLQLEAVNITDLSENRKQDKRFAFIRSD

SGPTTSFESAACPGWFLCTAMEADQPVSLTNMPDEGVMVTKFYFQEDE- (GGGGS)$_n$-DAHKSEVAHRFKDLGEENFKALVLIAFAQYLQQCPPEDHVK

LVNEVTEFAKTCVADESAENCDKSLHTLFGDKLCTVATLRETYGEMADCC

AKQEPERNECFLQHKDDNPNLPRLVRPEVDVMCTAFHDNEETFLKKYLYE

IARRHPYFYAPELLFFAKRYKAAFTECCQAADKAACLLPKLDELRDEGKA

SSAKQRLKCASLQKFGERAFKAWAVARLSQRFPKAEFAEVSKLVTDLTKV

HTECCHGDLLECADDRADLAKYICENQDSISSKLKECCEKPLLEKSHCIA

EVENDEMPADLPSLAADFVESKDVCKNYAEAKDVFLGMFLYEYARRHPDY

SVVLLLRLAKTYETTLEKCCAAADPHECYAKVFDEFKPLVEEPQNLIKQN

CELFEQLGEYKFQNALLVRYTKKVPQVSTPTLVEVSRNLGKVGSKCCKHP

EAKRMPCAEDYLSVVLNQLCVLHEKTPVSDRVTKCCTESLVNRRPCFSAL

EVDETYVPKEFNAETFTFHADICTLSEKERQIKKQTALVELVKHKPKATK

EQLKAVMDDFAAFVEKCCKADDKETCFAEEGKKLVAASQAALGL, wherein m and n are each 0, 1, 2, 3, 4, 5, or 6 and t2 is 0 or 1.

In one embodiment, the sequence of the fusion protein with the human albumin is:

(SEQ ID NO: 261)
HGEGTFTSDLSKQMEEEAVRLFIEWLKNGG(PSSGAPPPS)$_{t2}$HGEGTFT

SDLSKQMEEEAVRLFIEWLKNGG(PSSGAPPPS)$_{t2}$-(GGGGS)$_m$-DAHK

SEVAHRFKDLGEENFKALVLIAFAQYLQQCPFEDHVKLVNEVTEFAKTCV

ADESAENCDKSLHTLFGDKLCTVATLRETYGEMADCCAKQEPERNECFLQ

HKDDNPNLPRLVRPEVDVMCTAFHDNEETFLKKYLYEIARRHPYFYAPEL

LFFAKRYKAAFTECCQAADKAACLLPKLDELRDEGKASSAKQRLKCASLQ

KFGERAFKAWAVARLSQRFPKAEFAEVSKLVTDLTKVHTECCHGDLLECA

DDRADLAKYICENQDSISSKLKECCEKPLLEKSHCIAEVENDEMPADLPS

-continued

LAADFVESKDVCKNYAEAKDVFLGMFLYEYARRHPDYSVVLLLRLAKTYE

TTLEKCCAAADPHECYAKVFDEFKPLVEEPQNLIKQNCELFEQLGEYKFQ

NALLVRYTKKVPQVSTPTLVEVSRNLGKVGSKCCKHPEAKRMPCAEDYLS

VVLNQLCVLHEKTPVSDRVTKCCTESLVNRRPCFSALEVDETYVPKEFNA

ETFTFHADICTLSEKERQIKKQTALVELVKHKPKATKEQLKAVMDDFAAF

VEKCCKADDKETCFAEEGKKLVAASQAALGL-(GGGGS)$_n$-RPSGRKSSK

MQAFRIWDVNQKTFYLRNNQLVAGYLQGPNVNLEEKIDVVPIEPHALFLG

IHGGKMCLSCVKSGDETRLQLEAVNITDLSENRKQDKRFAFIRSDSGPTT

SFESAACPGWFLCTAMEADQPVSLTNMPDEGVMVTKFYFQEDE, wherein m and n are each 0, 1, 2, 3, 4, 5, or 6 and t2 is 0 or 1.

In one embodiment, the sequence of the fusion protein with IgG1 Fc is (SEQ ID NO: 262)
HGEGTFTSDLSKQMEEEAVRLFIEWLKNGGPSSGAPPPS-(GGGGS)$_m$-

X$_{IL0}$RPSGRKSSKMQAFRIWDVNQKTFYLRNNQLVAGYLQGPNVNLEEKI

DVVPIEPHALFLGIHGGKMCLSCVKSGDETRLQLEAVNITDLSENRKQDK

RFAFIRSDSGPTTSFESAACPGWFLCTAMEADQPVSLTNMPDEGVMVTKF

YFQEDE-(GGGGS)$_n$-AEPKSCDKTHTCPPCPAPELLGGPSVFLFPPKPK

DTLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK, wherein m and n are each 0, 1, 2, 3, 4, 5, or 6 and X$_{IL0}$ is a methionine, cysteine, general formula 1, general formula 2 or absent.

In one embodiment, the sequence of the fusion protein with IgG1 Fc is (SEQ ID NO: 263)
HGEGTFTSDLSKQMEEEAVRLFIEWLKNGGPSSGAPPPS-(GGGGS)$_m$-

AEPKSCDKTHTCPPCPAPELLGGPSVFLFPPKPKDTLMISRTPEVTCVV

VDVSHEDPEVKFNWYVDGVEVHNAKTKPREEQYNSTYRVVSVLTVLHQD

WLNGKEYKCKVSNKALPAPIEKTISKAKGQPREPQVYTLPPSREEMTKN

QVSLTCLVKGFYPSDIAVEWESNGQPENNYKTTPPVLDSDGSFFLYSKL

TVDKSRWQQGNVFSCSVMHEALHNHYTQKSLSLSPGK-(GGGGS)$_n$-

X$_{IL0}$RPSGRKSSKMQAFRIWDVNQKTFYLRNNQLVAGYLQGPNVNLEEKI

DVVPIEPHALFLGIHGGKMCLSCVKSGDETRLQLEAVNITDLSENRKQDK

RFAFIRSDSGPTTSFESAACPGWFLCTAMEADQPVSLTNMPDEGVMVTKF

YFQEDE, wherein m and n are each 0, 1, 2, 3, 4, 5, or 6 and X$_{IL0}$ is a methionine, cysteine, general formula 1, general formula 2 or absent.

In one embodiment, the sequence of the fusion protein with IgG1 Fc is (SEQ ID NO: 264)
HX$_{G2}$EGTFTSDVSSYLEX$_{G16}$QAAKEFIAWLVKGRG-(GGGGS)$_m$-X$_{IL0}$

RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSFESAACPGWFLCTAMEADQPVSLTNMPDEGVMVTKFYFQE

DE-(GGGGS)$_n$-AEPKSCDKTHTCPPCPAPELLGGPSVFLFPPKPKDTLM

ISRTPEVTCVVVDVSHEDPEVKFNWYVDGVEVHNAKTKPREEQYNSTYRV

VSVLTVLHQDWLNGKEYKCKVSNKALPAPIEKTISKAKGQPREPQVYTLP

PSREEMTKNQVSLTCLVKGFYPSDIAVEWESNGQPENNYKTTPPVLDSDG

SFFLYSKLTVDKSRWQQGNVFSCSVMHEALHNHYTQKSLSLSPGK, wherein m and n are each 0, 1, 2, 3, 4, 5, or 6 and other variables are individually defined as the above.

In one embodiment, the sequence of the fusion protein with IgG1 Fc is (SEQ ID NO: 265)
HX$_{G2}$EGTFTSDVSSYLEX$_{G16}$QAAKEFIAWLVKGRG-(GGGGS)$_m$-AEPK

SCDKTHTCPPCPAPELLGGPSVFLFPPKPKDTLMISRTPEVTCVVVDVSH

EDPEVKFNWYVDGVEVHNAKTKPREEQYNSTYRVVSVLTVLHQDWLNGKE

YKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQ

QGNVFSCSVMHEALHNHYTQKSLSLSPGK-(GGGGS)$_n$-X$_{IL0}$RPSGRKS

SKMQAFRIWDVNQKTFYLRNNQLVAGYLQGPNVNLEEKIDVVPIEPHALF

LGIHGGKMCLSCVKSGDETRLQLEAVNITDLSENRKQDKRFAFIRSDSGP

TTSFESAACPGWFLCTAMEADQPVSLTNMPDEGVMVTKFYFQEDE, wherein m and n are each 0, 1, 2, 3, 4, 5, or 6 and other variables are individually defined as the above.

The dimeric protein is a homodimer consisting of two identical sequences mentioned above, and connected by an interchain disulfide bond formed between the cysteines of the Fc portions of the two monomeric proteins.

In one embodiment, the sequence of the monomer in the fusion protein consisting of the IgG 4 Fc and the interleukin-1 receptor antagonistic protein is:

(SEQ ID NO: 266)
HX$_{G2}$EGTFTSDVSSYLEEQAAKEFIAWLVKGGG-(GGGGS)$_m$-RPSGRKS

SKMQAFRIWDVNQKTFYLRNNQLVAGYLQGPNVNLEEKIDVVPIEPHALF

LGIHGGKMCLSCVKSGDETRLQLEAVNITDLSENRKQDKRFAFIRSDSGP

TTSFESAAX$_{IL116}$PGWFLCTAMEADQPVSLTNMPDEGVMVTKFYFQED

E-(GGGGS)$_n$-AESKYGPP$\underline{C}$PP$\underline{C}$PAPEAAGGPSVFLFPPKPKDTLMISRT PEVTC$_a$VVVDVSQEDPEVQFNWYVDGVEVHNAKTKPREEQFNSTYRVVSV LTVLHQDWLNGKEYKC$_a$KVSNKGLPSSIEKTISKAKGQPREPQVYTLPPS QEEMTKNQVSLTC$_b$LVKGFYPSDIAVEWESNGQPENNYKTTPPVLDSDGS FFLYSRLTVDKSRWQEGNVFSC$_b$SVMHEALHNHYTQKSLSLSLG, wherein m and n are each 0, 1, 2, 3, 4, 5, or 6 and other variables are defined as the above.

The dimeric protein is a homodimer consisting of two identical sequences mentioned above. Each cysteine C underlined and the cysteine at the corresponding position in the other monomer form an interchain disulfide bond; an intrachain disulfide bond is formed between the C$_a$s in each monomer; and an intrachain disulfide bond is formed between the C$_b$s in each monomer.

In one embodiment, the sequence of the monomer in the fusion protein consisting of the IgG 4 Fc and the interleukin-1 receptor antagonistic protein is:

(SEQ ID NO: 267)
HGEGTFTSDLSKQMEEEAVRLFIEWLKNGG-(PSSGAPPPS)$_{t2}$-

(GGGGS)$_m$-RPSGRKSSKMQAFRIWDVNQKTFYLRNNQLVAGYLQGPNVN

LEEKIDVVPIEPHALFLGIHGGKMCLSCVKSGDETRLQLEAVNITDLSEN

RKQDKRFAFIRSDSGPTTSFESAAX$_{IL116}$PGWFLCTAMEADQPVSLTNM

PDEGVMVTKFYFQEDE-(GGGGS)$_n$-AESKYGPP$\underline{C}$PP$\underline{C}$PAPEAAGGPSVF LFPPKPKDTLMISRTPEVTC$_a$VVVDVSQEDPEVQFNWYVDGVEVHNAKTK PREEQFNSTYRVVSVLTVLHQDWLNGKEYKC$_a$KVSNKGLPSSIEKTISKA KGQPREPQVYTLPPSQEEMTKNQVSLTC$_b$LVKGFYPSDIAVEWESNGQPE NNYKTTPPVLDSDGSFFLYSRLTVDKSRWQEGNVFSC$_b$SVMHEALHNHYT

QKSLSLSLG, wherein m and n are each 0, 1, 2, 3, 4, 5, or 6 and other variables are defined as the above.

The dimeric protein is a homodimer consisting of two identical sequences mentioned above. Each cysteine C underlined and the cysteine at the corresponding position in the other monomer form an interchain disulfide bond; an intrachain disulfide bond is formed between the C$_a$s in each monomer; and an intrachain disulfide bond is formed between the C$_b$s in each monomer.

(2) the fusion protein consisting of the interleukin-1 receptor antagonistic protein—the linking group or spacer group—the GLP-1 receptor binding polypeptide The interleukin-1 receptor antagonistic protein can be cross-linked to the GLP-1 receptor binding polypeptide through a linking group (or a spacer group), by using a cysteine at position 116 or introducing a cysteine at position 0 (or at the N-terminus), 6, 8, 9, 84, 141, or 153 (or at the C-terminus).

In one embodiment, the sequence of the fusion protein is (SEQ ID NO: 268)
U$_L$-X$_{IL0}$RPSGRKSSKMQAFRIWDVNQKTFYLRNNQLVAGYLQGPNVLE

EKIDVVPIEPHALFLGIHGGKMCLSCVKSGDETRLQLEAVNITDLSENRK

QDKRFAFIRSDSGPTTSFESAAC (linking group - GLP-1 receptor binding polypeptide) PGWFLCTAMEADQPVSLTNMP

DEGVMVTKFYFQEDE;

In another embodiment, the sequence of the fusion protein is (SEQ ID NO: 269)
U$_L$-X$_{IL0}$RPSGRKSSKMQAFRIWDVNQKTFYLRNNQLVAGYLQGPNVLE EKIDVVPIEPHALFLGIHGGKMCLSCVKSGDETRLQLEAVC (linking group - GLP-1 receptor binding polypeptide) ITDLSE

NRKQDKRFAFIRSDSGPTTSFESAASPGWFLCTAMEADQPVSLTNMPDEG
VMVTKFYFQEDE;

wherein $U_L$ is a structure of —W—X—Y—Z, fatty acid, polyethylene glycol, albumin, IgG Fc, glycosyl, hydrogen atom, $N^\alpha$—($N^\alpha$—(HOOC(CH$_2$)$_n$CO)-γ-Glu)-, or $N^\alpha$—($N^\alpha$—(CH$_3$(CH$_2$)$_n$CO)-γ-Glu)-, in which n is an integer from 8 to 20, such as 10, 12, 14, 16, 18 or 20; $N^\alpha$ indicates the α-amino group of an amino acid or amino acid residue or general formula 5; and other variables are individually defined as the above. The structure of general formula 5 is In one particular embodiment, the molecular structure of the linking group may be maleimide-PEG-maleimide or I—CH$_2$—CONH-PEG-NHCO—CH$_2$—I; in one particular embodiment, the molecular structure of the linking group may be maleimide-(CH$_2$)$_n$-maleimide or I—CH$_2$—CONH—(CH$_2$)$_n$—NHCO—CH$_2$—I, in which n may be an integer from 1 to 30; in one particular embodiment, the molecular structure of the linking group may be maleimide-PEG-NHS. The GLP-1 receptor binding polypeptide may typically react with the linking group through the amino or mercapto group on the side chain of an amino acid residue.

In one embodiment, the sequence of the GLP-1 receptor binding polypeptide may be (SEQ ID NO: 270)
$X_{E1}X_{E2}$EGTFTSD$X_{E10}$S$X_{E12}$Q$X_{E14}$EEEAV$X_{E20}$LFIEWL$X_{E27}X_{E28}$
$X_{E29}X_{E30}$(P$X_{E32}X_{E33}$G$X_{E35}$PPPC)$_{t2}$;

(SEQ ID NO: 271)
$X_{E1}X_{E2}$EGTFTSD$X_{E10}$S$X_{E12}$Q$X_{E14}$EEEAV$X_{E20}$LFIEWL$X_{E27}X_{E28}$
$X_{E29}X_{E30}$(P$X_{E32}X_{E33}$GCPPP$X_{E39}$)$_{t2}$;

(SEQ ID NO: 272)
$X_{E1}X_{E2}$EGTFTSD$X_{E10}$S$X_{E12}$Q$X_{E14}$EEEAV$X_{E20}$LFIEWL$X_{E27}X_{E28}$
$X_{E29}X_{E30}$(P$X_{E32}$CG$X_{E35}$PPP$X_{E39}$)$_{t2}$;

(SEQ ID NO: 273)
$X_{E1}X_{E2}$EGTFTSD$X_{E10}$S$X_{E12}$Q$X_{E14}$EEEAV$X_{E20}$LFIEWL$X_{E27}X_{E28}$
$X_{E29}X_{E30}$(PC$X_{E33}$G$X_{E35}$PPP$X_{E39}$)$_{t2}$;

(SEQ ID NO: 274)
$X_{E1}X_{E2}$EGTFTSD$X_{E10}$S$X_{E12}$Q$X_{E14}$EEEAV$X_{E20}$LFIEWL$X_{E27}X_{E28}$
$X_{E29}$C(P$X_{E32}X_{E33}$G$X_{E35}$PPP$X_{E39}$)$_{t2}$;

(SEQ ID NO: 275)
$X_{E1}X_{E2}$EGTFTSD$X_{E10}$S$X_{E12}$Q$X_{E14}$EEEAV$X_{E20}$LFIEWL$X_{E27}X_{E28}$
C$X_{E30}$(P$X_{E32}X_{E33}$G$X_{E35}$PPP$X_{E39}$)$_{t2}$;

(SEQ ID NO: 276)
$X_{E1}X_{E2}$EGTFTSD$X_{E10}$S$X_{E12}$Q$X_{E14}$EEEAV$X_{E20}$LFIEWL$X_{E27}$C
$X_{E29}X_{E30}$(P$X_{E32}X_{E33}$G$X_{E35}$PPP$X_{E39}$)$_{t2}$;

(SEQ ID NO: 277)
$X_{E1}X_{E2}$EGTFTSD$X_{E10}$S$X_{E12}$Q$X_{E14}$EEEAV$X_{E20}$LFIEWLC$X_{E28}$
$X_{E29}X_{E30}$(P$X_{E32}X_{E33}$G$X_{E35}$PPP$X_{E39}$)$_{t2}$;

(SEQ ID NO: 278)
$X_{E1}X_{E2}$EGTFTSD$X_{E10}$S$X_{E12}$Q$X_{E14}$EEEAVCLFIEWL$X_{E27}X_{E28}$
$X_{E29}X_{E30}$(P$X_{E32}X_{E33}$G$X_{E35}$PPP$X_{E39}$)$_{t2}$;

(SEQ ID NO: 279)
$X_{E1}X_{E2}$EGTFTSD$X_{E10}$S$X_{E12}$QCEEEAV$X_{E20}$LFIEWL$X_{E27}X_{E28}$
$X_{E29}X_{E30}$(P$X_{E32}X_{E33}$G$X_{E35}$PPP$X_{E39}$)$_{t2}$;

(SEQ ID NO: 280)
$X_{E1}X_{E2}$EGTFTSD$X_{E10}$SCQ$X_{E14}$EEEAV$X_{E20}$LFIEWL$X_{E27}X_{E28}$
$X_{E29}X_{E30}$(P$X_{E32}X_{E33}$G$X_{E35}$PPP$X_{E39}$)$_{t2}$;

(SEQ ID NO: 281)
$X_{E1}X_{E2}$EGTFTSDCS$X_{E12}$Q$X_{E14}$EEEAV$X_{E20}$LFIEWL$X_{E27}X_{E28}$
$X_{E29}X_{E30}$(P$X_{E32}X_{E33}$G$X_{E35}$PPP$X_{E39}$)$_{t2}$;

the variables in the individual sequences are individually defined as the above.

In one particular embodiment, the sequence of the GLP-1 receptor binding polypeptide may be one of the following sequences:

(SEQ ID NO: 282)
HGEGTFTSDLSKQMEEEAVRLFIEWLKNGGPSSGAPPPSC;

(SEQ ID NO: 185)
HGEGTFTSDLSKQMEEEAVRLFIEWLKNGGPSSGAPPPC;

(SEQ ID NO: 284)
HGEGTFTSDLSKQMEEEAVRLFIEWLKNGGPSSGCPPPS;

(SEQ ID NO: 285)
HGEGTFTSDLSKQMEEEAVRLFIEWLKNGGPSCGAPPPS;

(SEQ ID NO: 286)
HGEGTFTSDLSKQMEEEAVRLFIEWLKNGGPCSGAPPPS;

(SEQ ID NO: 287)
HGEGTFTSDLSKQMEEEAVRLFIEWLKNGCPSSGAPPPS;

(SEQ ID NO: 288)
HGEGTFTSDLSKQMEEEAVRLFIEWLKNCGPSSGAPPPS;

(SEQ ID NO: 289)
HGEGTFTSDLSKQMEEEAVRLFIEWLKCGGPSSGAPPPS;

(SEQ ID NO: 188)
HGEGTFTSDLSKQMEEEAVRLFIEWLCNGGPSSGAPPPS;

(SEQ ID NO: 291)
HGEGTFTSDLSKQMEEEAVRLFIECLKNGGPSSGAPPPS;

(SEQ ID NO: 292)
HGEGTFTSDLSKQMEEEAVCLFIEWLKNGGPSSGAPPPS;

(SEQ ID NO: 293)
HGEGTFTSDLSKQCEEEAVRLFIEWLKNGGPSSGAPPPS;

(SEQ ID NO: 294)
HGEGTFTSDLSCQMEEEAVRLFIEWLKNGGPSSGAPPPS;

(SEQ ID NO: 295)
HGEGTFTSDCSKQMEEEAVRLFIEWLKNGGPSSGAPPPS;

(SEQ ID NO: 296)
HGEGTFTSDLSKQMEEEAVRLFIEWLKNGGC.

The GLP-1 receptor binding polypeptide is linked to the interleukin-1 receptor antagonistic protein by reacting the mercapto group on the side chain of a cysteine with the maleimide or iodoacetyl on the linking group.

In one embodiment, the sequence of the GLP-1 receptor binding polypeptide may be (SEQ ID NO: 297)
$X_{E1}X_{E2}$EGTFTSD$X_{E10}$S$X_{E12}$Q$X_{E14}$EEEAV$X_{E20}$LFIEWL$X_{E27}X_{E28}$$X_{E29}X_{E30}$(P$X_{E32}X_{E33}$G$X_{E35}$PPPK)$_{t2}$;

(SEQ ID NO: 298)
$X_{E1}X_{E2}$EGTFTSD$X_{E10}$S$X_{E12}$Q$X_{E14}$EEEAV$X_{E20}$LFIEWL$X_{E27}X_{E28}$$X_{E29}X_{E30}$(P$X_{E32}X_{E33}$GKPPP$X_{E39}$)$_{t2}$;

(SEQ ID NO: 299)
$X_{E1}X_{E2}$EGTFTSD$X_{E10}$S$X_{E12}$Q$X_{E14}$EEEAV$X_{E20}$LFIEWL$X_{E27}X_{E28}$$X_{E29}X_{E30}$(P$X_{E32}$KG$X_{E35}$PPP$X_{E39}$)$_{t2}$;

(SEQ ID NO: 300)
$X_{E1}X_{E2}$EGTFTSD$X_{E10}$S$X_{E12}$Q$X_{E14}$EEEAV$X_{E20}$LFIEWL$X_{E27}X_{E28}$$X_{E29}X_{E30}$(PK$X_{E33}$G$X_{E35}$PPP$X_{E39}$)$_{t2}$;

(SEQ ID NO: 301)
$X_{E1}X_{E2}$EGTFTSD$X_{E10}$S$X_{E12}$Q$X_{E14}$EEEAV$X_{E20}$LFIEWL$X_{E27}X_{E28}$$X_{E29}$K(P$X_{E32}X_{E33}$G$X_{E35}$PPP$X_{E39}$)$_{t2}$;

(SEQ ID NO: 302)
$X_{E1}X_{E2}$EGTFTSD$X_{E10}$S$X_{E12}$Q$X_{E14}$EEEAV$X_{E20}$LFIEWL$X_{E27}X_{E28}$K$X_{E30}$(P$X_{E32}X_{E33}$G$X_{E35}$PPP$X_{E39}$)$_{t2}$;

(SEQ ID NO: 303)
$X_{E1}X_{E2}$EGTFTSD$X_{E10}$S$X_{E12}$Q$X_{E14}$EEEAV$X_{E20}$LFIEWL$X_{E27}$K$X_{E29}X_{E30}$(P$X_{E32}X_{E33}$G$X_{E35}$PPP$X_{E39}$)$_{t2}$;

(SEQ ID NO: 304)
$X_{E1}X_{E2}$EGTFTSD$X_{E10}$S$X_{E12}$Q$X_{E14}$EEEAV$X_{E20}$LFIEWLK$X_{E28}$$X_{E29}X_{E30}$(P$X_{E32}X_{E33}$G$X_{E35}$PPP$X_{E39}$)$_{t2}$;

(SEQ ID NO: 305)
$X_{E1}X_{E2}$EGTFTSD$X_{E10}$S$X_{E12}$Q$X_{E14}$EEEAVKLFIEWL$X_{E27}X_{E28}$$X_{E29}X_{E30}$(P$X_{E32}X_{E33}$G$X_{E35}$PPP$X_{E39}$)$_{t2}$;

(SEQ ID NO: 306)
$X_{E1}X_{E2}$EGTFTSD$X_{E10}$S$X_{E12}$QKEEEAV$X_{E20}$LFIEWL$X_{E27}X_{E28}$$X_{E29}X_{E30}$(P$X_{E32}X_{E33}$G$X_{E35}$PPP$X_{E39}$)$_{t2}$;

(SEQ ID NO: 307)
$X_{E1}X_{E2}$EGTFTSD$X_{E10}$SKQ$X_{E14}$EHEEEAV$X_{E20}$LFIEWL$X_{E27}X_{E28}$$X_{E29}X_{E30}$(P$X_{E32}X_{E33}$G$X_{E35}$PPP$X_{E39}$)$_{t2}$;

(SEQ ID NO: 308)
$X_{E1}X_{E2}$EGTFTSDKS$X_{E12}$Q$X_{E14}$EEEAV$X_{E20}$LFIEWL$X_{E27}X_{E28}$$X_{E29}X_{E30}$(P$X_{E32}X_{E33}$G$X_{E35}$PPP$X_{E39}$)$_{t2}$;

the variables in the individual sequences are individually defined as the above.

In one particular embodiment, the sequence of the GLP-1 receptor binding polypeptide may be one of the following sequences:

(SEQ ID NO: 309)
HGEGTFTSDLSRQMEEEAVRLFIEWLRNGGPSSGAPPPSK;

(SEQ ID NO: 310)
HGEGTFTSDLSRQMEEEAVRLFIEWLRNGGPSSGAPPPK;

(SEQ ID NO: 311)
HGEGTFTSDLSRQMEEEAVRLFIEWLRNGGPSSGKPPPS;

(SEQ ID NO: 312)
HGEGTFTSDLSRQMEEEAVRLFIEWLRNGGPSKGAPPPS;

(SEQ ID NO: 313)
HGEGTFTSDLSRQMEEEAVRLFIEWLRNGGPKSGAPPPS;

(SEQ ID NO: 314)
HGEGTFTSDLSRQMEEEAVRLFIEWLRNGKPSSGAPPPS;

(SEQ ID NO: 315)
HGEGTFTSDLSRQMEEEAVRLFIEWLRNKGPSSGAPPPS;

(SEQ ID NO: 316)
HGEGTFTSDLSRQMEEEAVRLFIEWLRKGGPSSGAPPPS;

(SEQ ID NO: 317)
HGEGTFTSDLSRQMEEEAVRLFIEWLKNGGPSSGAPPPS;

(SEQ ID NO: 318)
HGEGTFTSDLSRQMEEEAVRLFIEKLRNGGPSSGAPPPS;

(SEQ ID NO: 319)
HGEGTFTSDLSRQMEEEAVKLFIEWLRNGGPSSGAPPPS;

(SEQ ID NO: 320)
HGEGTFTSDLSRQKEEEAVRLFIEWLRNGGPSSGAPPPS;

(SEQ ID NO: 321)
HGEGTFTSDLSKQMEEEAVRLFIEWLRNGGPSSGAPPPS;

(SEQ ID NO: 322)
HGEGTFTSDKSRQMEEEAVRLFIEWLRNGGPSSGAPPPS;

(SEQ ID NO: 323)
HGEGTFTSDLSRQMEEEAVRLFIEWLRNGK-NH$_2$.

The GLP-1 receptor binding polypeptide is reacted with the N-hydroxyl succinimidyl ester of the linking group through the amino group on the side chain of a lysine, thus linking to the interleukin-1 receptor antagonistic protein.

In one embodiment, the sequence of the GLP-1 receptor binding polypeptide may be (SEQ ID NO: 324)
$X_{G1}X_{G2}$EGTFTSD$X_{G10}$S$X_{G12}$YLE$X_{G16}$QAA$X_{G20}$EFIAWLV$X_{G28}$$X_{G29}X_{G30}$(P$X_{E32}X_{E33}$G$X_{E35}$PPPC)$_{t2}$;

(SEQ ID NO: 325)
$X_{G1}X_{G2}$EGTFTSD$X_{G10}$S$X_{G12}$YLE$X_{G16}$QAA$X_{G20}$EFIAWLV$X_{G28}$$X_{G29}X_{G30}$(P$X_{E32}X_{E33}$GCPPP$X_{E39}$)$_{t2}$;

(SEQ ID NO: 326)
$X_{G1}X_{G2}$EGTFTSD$X_{G10}$S$X_{G12}$YLE$X_{G16}$QAA$X_{G20}$EFIAWLV$X_{G28}$$X_{G29}X_{G30}$(P$X_{E32}$CG$X_{E35}$PPP$X_{E39}$)$_{t2}$;

(SEQ ID NO: 327)
$X_{G1}X_{G2}$EGTFTSD$X_{G10}$S$X_{G12}$YLE$X_{G16}$QAA$X_{G20}$EFIAWLV$X_{G28}$$X_{G29}X_{G30}$(PC$X_{E33}$G$X_{E35}$PPP$X_{E39}$)$_{t2}$;

(SEQ ID NO: 328)
$X_{G1}X_{G2}$EGTFTSD$X_{G10}$S$X_{G12}$YLE$X_{G16}$QAA$X_{G20}$EFIAWLV$X_{G28}$$X_{G29}X_{G30}$C;

(SEQ ID NO: 329)
$X_{G1}X_{G2}EGTFTSDX_{G10}SX_{G12}YLEX_{G16}QAAX_{G20}EFIAWLVX_{G28}X_{G29}C-NH_2;$ (SEQ ID NO: 330)
$X_{G1}X_{G2}EGTFTSDX_{G10}SX_{G12}YLEX_{G16}QAAX_{G20}EFIAWLVX_{G28}CX_{G30}X_{G31};$ (SEQ ID NO: 331)
$X_{G1}X_{G2}EGTFTSDX_{G10}SX_{G12}YLEX_{G16}QAAX_{G20}EFIAWLVCX_{G29}X_{G30}X_{G31};$ (SEQ ID NO: 332)
$X_{G1}X_{G2}EGTFTSDX_{G10}SX_{G12}YLEX_{G16}QAAX_{G20}EFIACLVX_{G28}X_{G29}X_{G30}X_{G31};$ (SEQ ID NO: 333)
$X_{G1}X_{G2}EGTFTSDX_{G10}SX_{G12}YLEX_{G16}QAACEFIAWLVX_{G28}X_{G29}X_{G30}X_{G31};$ (SEQ ID NO: 334)
$X_{G1}X_{G2}EGTFTSDX_{G10}SCYLEX_{G16}QAAX_{G20}EFIAWLVX_{G28}X_{G29}X_{G30}X_{G31};$ (SEQ ID NO: 335)
$X_{G1}X_{G2}EGTFTSDCSX_{G12}YLEX_{G16}QAAX_{G20}EFIAWLVX_{G28}X_{G29}X_{G30}X_{G31};$ the variables in the individual sequences are individually defined as the above.

In one particular embodiment, the sequence of the GLP-1 receptor binding polypeptide may be one of the following sequences:

(SEQ ID NO: 336)
$HX_{G2}EGTFTSDVSSYLEX_{G16}QAAKEFIAWLVKGRPSSGAPPPC;$ (SEQ ID NO: 337)
$HX_{G2}EGTFTSDVSSYLEX_{G16}QAAKEFIAWLVKGRPSSGCPPPS;$ (SEQ ID NO: 338)
$HX_{G2}EGTFTSDVSSYLEX_{G16}QAAKEFIAWLVKGRPSCGAPPPS;$ (SEQ ID NO: 339)
$HX_{G2}EGTFTSDVSSYLEX_{G16}QAAKEFIAWLVKGRPCSGAPPPS;$ (SEQ ID NO: 340)
$HX_{G2}EGTFTSDVSSYLEX_{G16}QAAKEFIAWLVKGRC;$ (SEQ ID NO: 341)
$HX_{G2}EGTFTSDVSSYLEX_{G16}QAAKEFIAWLVKGC-NH_2;$ (SEQ ID NO: 342)
$HX_{G2}EGTFTSDVSSYLEX_{G16}QAAKEFIAWLVKCRG;$ (SEQ ID NO: 343)
$HX_{G2}EGTFTSDVSSYLEX_{G16}QAAKEFIAWLVCGRG;$ (SEQ ID NO: 344)
$HX_{G2}EGTFTSDVSSYLEX_{G16}QAAKEFIAWLVCGR-NH_2;$ (SEQ ID NO: 345)
$HX_{G2}EGTFTSDVSSYLEX_{G16}QAAKEFIACLVKGRG;$ (SEQ ID NO: 346)
$HX_{G2}EGTFTSDVSSYLEX_{G16}QAACEFIAWLVKGRG;$ (SEQ ID NO: 347)
$HX_{G2}EGTFTSDVSSYLEX_{G16}QAACEFIAWLVKGR-NH_2;$ (SEQ ID NO: 348)
$HX_{G2}EGTFTSDVSCYLEX_{G16}QAAKEFIAWLVKGRG;$ (SEQ ID NO: 349)
$HX_{G2}EGTFTSDCSSYLEX_{G16}QAAKEFIAWLVKGRG;$ (SEQ ID NO: 350)
$HX_{G2}EGTFTSDCSSYLEX_{G16}QAAKEFIAWLVKGR-NH_2;$ the variables in the individual sequences are individually defined as the above.

The polypeptide is linked to the interleukin-1 receptor antagonistic protein by reacting the mercapto group on the side chain of a cysteine with the maleimide or iodoacetyl on one terminus of the linking group.

In one embodiment, the sequence of the GLP-1 receptor binding polypeptide may be:

(SEQ ID NO: 351)
$X_{G1}X_{G2}EGTFTSDX_{G10}SX_{G12}YLEX_{G16}QAAX_{G20}EFIAWLVX_{G28}X_{G29}X_{G30}(PX_{E32}X_{E33}GX_{E35}PPPK)_{t2};$ (SEQ ID NO: 352)
$X_{G1}X_{G2}EGTFTSDX_{G10}SX_{G12}YLEX_{G16}QAAX_{G20}EFIAWLVX_{G28}X_{G29}X_{G30}(PX_{E32}X_{E33}GKPPPX_{E39})_{t2};$ (SEQ ID NO: 353)
$X_{G1}X_{G2}EGTFTSDX_{G10}SX_{G12}YLEX_{G16}QAAX_{G20}EFIAWLVX_{G28}X_{G29}X_{G30}(PX_{E32}KGX_{E35}PPPX_{E39})_{t2};$ (SEQ ID NO: 354)
$X_{G1}X_{G2}EGTFTSDX_{G10}SX_{G12}YLEX_{G16}QAAX_{G20}EFIAWLVX_{G28}X_{G29}X_{G30}(PKX_{E33}GX_{E35}PPPX_{E39})_{t2};$ (SEQ ID NO: 355)
$X_{G1}X_{G2}EGTFTSDX_{G10}SX_{G12}YLEX_{G16}QAAX_{G20}EFIAWLVX_{G28}X_{G29}X_{G30}K;$ (SEQ ID NO: 356)
$X_{G1}X_{G2}EGTFTSDX_{G10}SX_{G12}YLEX_{G16}QAAX_{G20}EFIAWLVX_{G28}X_{G29}K-NH_2;$ (SEQ ID NO: 357)
$X_{G1}X_{G2}EGTFTSDX_{G10}SX_{G12}YLEX_{G16}QAAX_{G20}EFIAWLVX_{G28}KX_{G30}X_{G31};$ (SEQ ID NO: 358)
$X_{G1}X_{G2}EGTFTSDX_{G10}SX_{G12}YLEX_{G16}QAAX_{G20}EFIAWLVK\ X_{G29}X_{G30}X_{G31};$ (SEQ ID NO: 359)
$X_{G1}X_{G2}EGTFTSDX_{G10}SX_{G12}YLEX_{G16}QAAX_{G20}EFIAKLVX_{G28}X_{G29}X_{G30}X_{G31};$ (SEQ ID NO: 360)
$X_{G1}X_{G2}EGTFTSDX_{G10}SX_{G12}YLEX_{G16}QAAKEFIAWLVX_{G28}\ X_{G29}X_{G30}X_{G31};$ (SEQ ID NO: 361)
$X_{G1}X_{G2}EGTFTSDX_{G10}SKYLEX_{G16}QAAX_{G20}EFIAWLVX_{G28}X_{G29}X_{G30}X_{G31};$ (SEQ ID NO: 362)
$X_{G1}X_{G2}EGTFTSDKSX_{G12}YLEX_{G16}QAAX_{G20}EFIAWLVX_{G28}X_{G29}X_{G30}X_{G31};$ and
the variables in the individual sequences are individually defined as the above.

In one particular embodiment, the sequence of the GLP-1 receptor binding polypeptide may be one of the following sequences:

HX$_{G2}$EGTFTSDVSSYLEX$_{G16}$QAAREFIAWLVRGRPSSGAPPPK; (SEQ ID NO: 363)

HX$_{G2}$EGTFTSDVSSYLEX$_{G16}$QAAREFIAWLVRGRPSSGKPPPS; (SEQ ID NO: 364)

HX$_{G2}$EGTFTSDVSSYLEX$_{G16}$QAAREFIAWLVRGRPSKGAPPPS; (SEQ ID NO: 365)

HX$_{G2}$EGTFTSDVSSYLEX$_{G16}$QAAREFIAWLVRGRPKSGAPPPS; (SEQ ID NO: 366)

HX$_{G2}$EGTFTSDVSSYLEX$_{G16}$QAAREFIAWLVRGRK; (SEQ ID NO: 367)

HX$_{G2}$EGTFTSDVSSYLEX$_{G16}$QAAREFIAWLVRGK-NH$_2$; (SEQ ID NO: 368)

HX$_{G2}$EGTFTSDVSSYLEX$_{G16}$QAAREFIAWLVRKRG; (SEQ ID NO: 369)

HX$_{G2}$EGTFTSDVSSYLEX$_{G16}$QAAREFIAWLVKGRG; (SEQ ID NO: 370)

HX$_{G2}$EGTFTSDVSSYLEX$_{G16}$QAAREFIAKLVRGRG; (SEQ ID NO: 371)

HX$_{G2}$EGTFTSDVSSYLEX$_{G16}$QAAKEFIAWLVRGRG; (SEQ ID NO: 372)

HX$_{G2}$EGTFTSDVSSYLEX$_{G16}$QAAKEFIAWLVRGR-NH$_2$; (SEQ ID NO: 373)

HX$_{G2}$EGTFTSDVSKYLEX$_{G16}$QAAREFIAWLVRGRG; (SEQ ID NO: 374)

HX$_{G2}$EGTFTSDKSSYLEX$_{G16}$QAAREFIAWLVRGRG; (SEQ ID NO: 375)
and

HX$_{G2}$EGTFTSDKSSYLEX$_{G16}$QAAREFIAWLVRGR-NH$_2$; (SEQ ID NO: 376)

the variables in the individual sequences are individually defined as the above.

The GLP-1 receptor binding polypeptide is reacted with the N-hydroxyl succinimidyl ester of the linking group through the amino group on the side chain of a lysine, thus linking to the interleukin-1 receptor antagonistic protein.

In one embodiment, the sequence of the fusion protein is (SEQ ID NO: 377)
(GLP-1 receptor binding polypeptide - linking group)-C$_{IL0}$-X$_{IL0}$RPSGRKSSKMQAFRIWDVNQKTFYLRNNQLVAGY

LQGPNVNLEEKIDVVPIEPHALFLGIHGGKMX$_{IL66}$LSX$_{IL69}$VKSGDET

RLQLEAVX$_{IL84}$ITDLSENRKQDKRFAFIRSDSGPTTSFESAAX$_{IL116}$P

GWFLX$_{IL122}$TAMEADQPVSLTNMPDEGVMVTKEYFQEDE;
or (SEQ ID NO: 378)
C$_{IL0}$(linking group - GLP-1 receptor binding polypeptide)

X$_{IL0}$RPSGRKSSKMQAFRIWDVNQKTFYLRNN-QLVAGYLQGPNVNLEEK

IDVVPIEPHALFLGIHGGKMCLSCVKSGDETRLQLEAVNITDLSENRKQD

KRFAFIRSDSGPTTSPESAAX$_{IL116}$PGWFLCTAMEADQPVSLTNMPDEG

VMVTKFYFQEDE;
or (SEQ ID NO: 379)
U$_L$-X$_{IL0}$RPSGRKSSKMQAFRIWDVNQKTFYLRNNQLVAGYLQGPNVNLE

EKIDVVPIEPHALFLGIHGGKMX$_{IL66}$LSX$_{IL69}$VKSGDETRLQLEAV

X$_{IL84}$ITDLSENRKQDKRFAFIRSDSGPTTSFESAAX$_{IL116}$PGWFL

X$_{IL122}$TAMEADQPVSLTNMPDEGVMVTKFYFQEDEC$_{IL153}$ (linking group - GLP-1 receptor binding polypeptide);
wherein C$_{IL0}$ and C$_{IL153}$ are cysteines or absent and other variables are respectively defined as the above. The linking group is defined as herein. In one embodiment, the linking group has an aldehyde group and is linked to the N-terminus of the interleukin-1 receptor antagonistic protein through reductive amination; in another embodiment, C$_{IL0}$ cysteine is linked to the linking group via the mercapto group on the side chain, and then is linked to the GLP-1 receptor binding polypeptide.

The GLP-1 receptor binding polypeptide may typically react with the linking group through the amino or mercapto group on the side chain of an amino acid residue.

In one embodiment, the GLP-1 receptor binding polypeptide is a modified conjugate. The sequences of the fusion protein/dimeric protein/cross-linking protein of the GLP-1 receptor binding polypeptide and the interleukin-1 receptor antagonistic protein are selected from:

G-1:

(SEQ ID NO: 1)
HGEGTFTSDLSKQMEEEAVRLFIEWLKNGGPSSGAPPPSRPSGRKSSKMQAFRIWDVNQ

KTFYLRNNQLVAGYLQGPNVNLEEKIDVVPIEPHALFLGIHGGKMCLSCVKSGDETRLQ

LEAVNITDLSENRKQDKRFAFIRSDSGPTTSFESAACPGWFLCTAMEADQPVSLTNMPDE

GVMVTKFYFQEDE;

G-2:

(SEQ ID NO: 2)
HGEGTFTSDLSKQMEEEAVRLFIEWLKNGGPSSGAPPPSGGGGSRPSGRKSSKMQAFRI

WDVNQKTFYLRNNQLVAGYLQGPNVNLEEKIDVVPIEPHALFLGIHGGKMCLSCVKSG

DETRLQLEAVNITDLSENRKQDKRFAFIRSDSGPTTSFESAACPGWFLCTAMEADQPVSL

TNMPDEGVMVTKFYFQEDE;

G-3: (SEQ ID NO: 3)

HGEGTFTSDLSKQMEEEAVRLFIEWLKNGGPSSGAPPPSGGGGSGGGGSRPSGRKSSKM

QAFRIWDVNQKTFYLRNNQLVAGYLQGPNVNLEEKIDVVPIEPHALFLGIHGGKMCLSC

VKSGDETRLQLEAVNITDLSENRKQDKRFAFIRSDSGPTTSFESAACPGWFLCTAMEADQ

PVSLTNMPDEGVMVTKFYFQEDE;

G-4: (SEQ ID NO: 4)

HGEGTFTSDLSKQMEEEAVRLFIEWLKNGGPSSGAPPPSGGGGSGGGGSGGGGSRPSGR

KSSKMQAFRIWDVNQKTFYLRNNQLVAGYLQGPNVNLEEKIDVVPIEPHALFLGIHGGK

MCLSCVKSGDETRLQLEAVNITDLSENRKQDKRFAFIRSDSGPTTSFESAACPGWFLCTA

MEADQPVSLTNMPDEGVMVTKFYFQEDE;

G-5: (SEQ ID NO: 5)

HGEGTFTSDLSKQMEEEAVRLFIEWLKNGGRPSGRKSSKMQAFRIWDVNQKTFYLRNN

QLVAGYLQGPNVNLEEKIDVVPIEPHALFLGIHGGKMCLSCVKSGDETRLQLEAVNITDL

SENRKQDKRFAFIRSDSGPTTSFESAACPGWFLCTAMEADQPVSLTNMPDEGVMVTKFY

FQEDE;

G-6: (SEQ ID NO: 6)

HGEGTFTSDLSKQMEEEAVRLFIEWLKNGGGGSRPSGRKSSKMQAFRIWDVNQKTFYL

RNNQLVAGYLQGPNVNLEEKIDVVPIEPHALFLGIHGGKMCLSCVKSGDETRLQLEAVNI

TDLSENRKQDKRFAFIRSDSGPTTSFESAACPGWFLCTAMEADQPVSLTNMPDEGVMVT

KFYFQEDE;

G-7: (SEQ ID NO: 7)

HGEGTFTSDLSKQMEEEAVRLFIEWLKNGGGGSGGGGSRPSGRKSSKMQAFRIWDVNQ

KTFYLRNNQLVAGYLQGPNVNLEEKIDVVPIEPHALFLGIHGGKMCLSCVKSGDETRLQ

LEAVNITDLSENRKQDKRFAFIRSDSGPTTSFESAACPGWFLCTAMEADQPVSLTNMPDE

GVMVTKFYFQEDE;

G-8: (SEQ ID NO: 8)

HGEGTFTSDLSKQMEEEAVRLFIEWLKNGGGGSGGGGSGGGGSRPSGRKSSKMQAFRI

WDVNQKTFYLRNNQLVAGYLQGPNVNLEEKIDVVPIEPHALFLGIHGGKMCLSCVKSG

DETRLQLEAVNITDLSENRKQDKRFAFIRSDSGPTTSFESAACPGWFLCTAMEADQPVSL

TNMPDEGVMVTKFYFQEDE;

G-9: (SEQ ID NO: 9)

HGEGTFTSDLSKQMEEEAVRLFIEWLKNGGPSSGAPPPSGGGGSRPSGRKSSKMQAFRI

WDVNQKTFYLRNNQLVAGYLQGPNVNLEEKIDVVPIEPHALFLGIHGGKMCLSCVKSG

DETRLQLEAVNITDLSENRKQDKRFAFIRSDSGPTTSFESAAC[$S$-maleimide-$(CH_2)_4$-NH-($N^{\alpha}$-

($HOOC(CH_2)_{14}CO$)-$\gamma$-Glu)]PGWFLCTAMEADQPVSLTNMPDEGVMVTKFYFQEDE($S$ is the sulphur atom on the side chain of a cysteine residue);

G-10:
(SEQ ID NO: 10)
HGEGTFTSDLSKQMEEEAVRLFIEWLKNGGPSSGAPPPSGGGGSRPSGRKSSKMQAFRI

WDVNQKTFYLRNNQLVAGYLQGPNVNLEEKIDVVPIEPHALFLGIHGGKMCLSCVKSG

DETRLQLEAVC(<u>S</u>-CH$_2$-CONH-PEG20K)ITDLSENRKQDKRFAFIRSDSGPTTSFESAASPG

WFLCTAMEADQPVSLTNMPDEGVMVTKFYFQEDE(<u>S</u>is the sulphur atom on the side chain of a cysteine residue);

G-11:
(SEQ ID NO: 11)
HGEGTFTSDLSKQMEEEAVRLFIEWLKNGGGGGSGGGGSRPSGRKSSKMQAFRIWDVN

QKTFYLRNNQLVAGYLQGPNVNLEEKIDVVPIEPHALFLGIHGGKMCLSCVKSGDETRL

QLEAVNITDLSENRKQDKRFAFIRSDSGPTTSFESAAC(<u>S</u>-CH$_2$-CONH-PEG20K)PGWF

LCTA MEADQPVSLTNMPDEGVMVTKFYFQEDE(<u>S</u> is the sulphur atom on the side chain of a cysteine residue);

G-12:
(SEQ ID NO: 12)
HGEGTFTSDLSKQMEEEAVRLFIEWLKNGGPSSGAPPPSGGGGSGGGGSRPSGRKSSKM

QAFRIWDVNQKTFYLRNNQLVAGYLQGPNVNLEEKIDVVPIEPHALFLGIHGGKMCLSC

VKSGDETRLQLEAVC[<u>S</u>-maleimide-(CH$_2$)$_4$-NH-(N$^\alpha$-(HOOC(CH$_2$)$_{14}$CO)-γ-Glu)]ITDLSENRK

QDKRFAFIRSDSGPTTSFESAASPGWFLCTAMEADQPVSLTNMPDEGVMVTKFYFQEDE (<u>S</u> is the sulphur atom on the side chain of a cysteine residue);

G-13:
(SEQ ID NO: 13)
HGEGTFTSDLSKQMEEEAVRLFIEWLKNGGGGSRPSGRKSSKMQAFRIWDVNQKTFYL

RNNQLVAGYLQGPNVNLEEKIDVVPIEPHALFLGIHGGKMCLSCVKSGDETRLQLEAVNI

TDLSENRKQDKRFAFIRSDSGPTTSFESAAC(<u>S</u>-maleimide-PEG20K)PGWFLCTAMEAD

QPVSLTNMPDEGVMVTKFYFQEDE(<u>S</u> is the sulphur atom on the side chain of a cysteine residue);

G-14:
(SEQ ID NO: 14)
HGEGTFTSDLSKQMEEEAVRLFIEWLKNGGGGSRPSGRKSSKMQAFRIWDVNQKTFYL

RNNQLVAGYLQGPNVNLEEKIDVVPIEPHALFLGIHGGKMCLSCVKSGDETRLQLEAVC

[<u>S</u>-maleimide-(CH$_2$)$_4$-NH-(N$^\alpha$-(HOOC(CH$_2$)$_{14}$CO)-γ-Glu)]ITDLSENRKQDKRFAFIRS DSGPTTSFESAASPGWFLCTAME ADQPVSLTNMPDEGVMVTKFYFQEDE(<u>S</u> is the sulphur atom on the side chain of a cysteine residue);

G-15:
(SEQ ID NO: 15)
HGEGTFTSDLSKQMEEEAVRLFIEWLC[<u>S</u>-maleimide-(CH$_2$)$_4$-NH-(N$^\alpha$-(HOOC(CH$_2$)$_{14}$CO)-

γ-Glu)]NGGPSSGAPPPSGGGGSGGGGSRPSGRKSSKMQAFRIWDVNQKTFYLRNNQLV

AGYLQGPNVNLEEKIDVVPIEPHALFLGIHGGKMCLSCVKSGDETRLQLEAVNITDLSEN

RKQDKRFAFIRSDSGPTTSFESAASPGWFLCTAMEADQPVSLTNMPDEGVMVTKFYFQE

DE(<u>S</u> is the sulphur atom on the side chain of a cysteine residue);

G-16:
(SEQ ID NO: 16)
HGEGTFTSDLSKQMEEEAVRLFIEWLKNGGPSSGAPPPC(<u>S</u>-CH$_2$-CONH-PEG20K)GGGG

SGGGGSRPSGRKSSKMQAFRIWDVNQKTFYLRNNQLVAGYLQGPNVNLEEKIDVVPIEP

HALFLGIHGGKMCLSCVKSGDETRLQLEAVNITDLSENRKQDKRFAFIRSDSGPTTSFESA

-continued

ASPGWFLCTAMEADQPVSLTNMPDEGVMVTKFYFQEDE(_S_ is the sulphur atom on the side chain of a cysteine residue);

G-17:

(SEQ ID NO: 17)

HGEGTFTSDLSKQMEEEAVC[_S_-maleimide-(CH$_2$)$_4$-NH-(N$^\alpha$-(HOOC(CH$_2$)$_{14}$CO)-γ-Glu)]

LFIEWLKNGGPSSGAPPPSGGGGSGGGGSRPSGRKSSKMQAERIWDVNQKTFYLRNNQL

VAGYLQGPNVNLEEKIDVVPIEPHALFLGIHGGKMCLSCVKSGDETRLQLEAVNITDLSE

NRKQDKRFAFIRSDSGPTTSFESAASPGWFLCTAMEADQPVSLTNMPDEGVMVTKFYFQ

EDE(_S_ is the sulphur atom on the side chain of a cysteine residue);

G-18:

(SEQ ID NO: 18)

HGEGTFTSDVSSYLEEQAAKEFIAWLVKGRGRPSGRKSSKMQAFRIWDVNQKTFYLRN

NQLVAGYLQGPNVNLEEKIDVVPIEPHALFLGIHGGKMCLSCVKSGDETRLQLEAVNITD

LSENRKQDKRFAFIRSDSGPTTSFESAACPGWFLCTAMEADQPVSLTNMPDEGVMVTKF

YFQEDE;

G-19:

(SEQ ID NO: 19)

HGEGTFTSDVSSYLEEQAAKEFIAWLVKGRGGGGSRPSGRKSSKMQAFRIWDVNQKTF

YLRNNQLVAGYLQGPNVNLEEKIDVVPIEPHALFLGIHGGKMCLSCVKSGDETRLQLEA

VNITDLSENRKQDKRFAFIRSDSGPTTSFESAACPGWFLCTAMEADQPVSLTNMPDEGV

MVTKFYFQEDE;

G-20:

(SEQ ID NO: 20)

HGEGTFTSDVSSYLEEQAAKEFIAWLVKGRGGGGSGGGGSRPSGRKSSKMQAPRIWDV

NQKTFYLRNNQLVAGYLQGPNVNLEEKIDVVPIEPHALFLGIHGGKMCLSCVKSGDETR

LQLEAVNITDLSENRKQDKRFAFIRSDSGPTTSFESAACPGWFLCTAMEADQPVSLTNMP

DEGVMVTKFYFQEDE;

G-21:

(SEQ ID NO: 21)

HGEGTFTSDVSSYLEEQAAKEFIAWLVKGRGGGGSGGGGSGGGGSRPSGRKSSKMQAF

RIWDVNQKTFYLRNNQLVAGYLQGPNVNLEEKIDVVPIEPHALFLGIHGGKMCLSCVKS

GDETRLQLEAVNITDLSENRKQDKRFAFIRSDSGPTTSFESAACPGWFLCTAMEADQPVS

LTNMPDEGVMVTKFYFQEDE;

G-22:

(SEQ ID NO: 22)

HGEGTFTSDVSSYLEEQAAKEFIAWLVKGRPSSGAPPPSGGGGSGGGGSRPSGRKSSKM

QAFRIWDVNQKTFYLRNNQLVAGYLQGPNVNLEEKIDVVPIEPHALFLGIHGGKMCLSC

VKSGDETRLQLEAVNITDLSENRKQDKRFAFIRSDSGPTTSFESAACPGWFLCTAMEADQ

PVSLTNMPDEGVMVTKFYFQEDE;

G-23:

(SEQ ID NO: 23)

HGEGTFTSDVSSYLEEQAAKEFIAWLVKGRGRPSGRKSSKMQAFRIWDVNQKTFYLRN

NQLVAGYLQGPNVNLEEKIDVVPIEPHALFLGIHGGKMCLSCVKSGDETRLQLEAVNITD

LSENRKQDKRFAFIRSDSGPTTSFESAAC(_S_-CH$_2$-CONH-PEG20K)PGWFLCTAMEADQPV

SLTNMPDEGVMVTKFYFQEDE(_S_ is the sulphur atom on the side chain of a cysteine residue);

G-24:

(SEQ ID NO: 24)

HGEGTFTSDVSSYLEEQAAKEFIAWLVKGRGGGGSRPSGRKSSKMQAFRIWDVNQKTF

YLRNNQLVAGYLQGPNVNLEEKIDVVPIEPHALFLGIHGGKMCLSCVKSGDETRLQLEA

-continued

VNITDLSENRKQDKRFAFIRSDSGPTTSFESAAC(S-CH$_2$-CONH-PEG20K)PGWFLCTAME

ADQPVSLTNMPDEGVMVTKFYFQEDE(S is the sulphur atom on the side chain of a cysteine residue);

G-25:

(SEQ ID NO: 25)

HGEGTFTSDVSSYLEEQAAKEFIAWLVKGRGGGGSRPSGRKSSKMQAFRIWDVNQKTF

YLRNNQLVAGYLQGPNVNLEEKIDVVPIEPHALFLGIHGGKMCLSCVKSGDETRLQLEA

VC[S-maleimide-(CH$_2$)$_4$-NH-(N$^\alpha$-(HOOC(CH$_2$)$_{14}$CO)-γ-Glu)]ITDLSENRKQDKRFAFIRS DSGPTTSFESAASPGWFLCTAME ADQPVSLTNMPDEGVMVTKFYFQEDE(S is the sulphur atom on the side chain of a cysteine residue);

G-26:

(SEQ ID NO: 26)

HGEGTFTSDVSSYLEEQAAKEFIAWLVKGRGGGGSGGGGSRPSGRKSSKMQAPRIWDV

NQKTFYLRNNQLVAGYLQGPNVNLEEKIDVVPIEPHALFLGIHGGKMCLSCVKSGDETR

LQLEAVNITDLSENRKQDKRFAFIRSDSGPTTSFESAAC(S-CH$_2$-CONH-PEG20K)PGWFLC

TAMEADQPVSLTNMPDEGVMVTKFYFQEDE(S is the sulphur atom on the side chain of a cysteine residue);

G-27:

(SEQ ID NO: 27)

HGEGTFTSDVSSYLEEQAAKEFIAWLVKGRGGGGSGGGGSRPSGRKSSKMQAPRIWDV

NQKTFYLRNNQLVAGYLQGPNVNLEEKIDVVPIEPHALFLGIHGGKMCLSCVKSGDETR

LQLEAVC[S-maleimide-(CH$_2$)$_4$-NH-(N$^\alpha$-(HOOC(CH$_2$)$_{14}$CO)-γ-Glu)]ITDLSENRKQDKR FAFIRSDSGPTTSFESAASPGWFLCTAMEADQPVSLTNMPDEGVMVTKFYFQEDE(S is the sulphur atom on the side chain of a cysteine residue);

G-28:

(SEQ ID NO: 28)

HGEGTFTSDVSSYLEEQAAKEFIAWLVKGRGGGGSGGGGSGGGGSRPSGRKSSKMQAF

RIWDVNQKTFYLRNNQLVAGYLQGPNVNLEEKIDVVPIEPHALFLGIHGGKMCLSCVKS

GDETRLQLEAVNITDLSENRKQDKRFAFIRSDSGPTTSFESAAC(S-CH$_2$-CONH-PEG20K)P

GWFLCTAMEADQPVSLTNMPDEGVMVTKFYFQEDE(S is the sulphur atom on the side chain of a cysteine residue);

G-29:

(SEQ ID NO: 29)

HGEGTFTSDVSSYLEEQAAKEFIAWLVKGRPSSGAPPPSGGGGSGGGGSRPSGRKSSKM

QAFRIWDVNQKTFYLRNNQLVAGYLQGPNVNLEEKIDVVPIEPHALFLGIHGGKMCLSC

VKSGDETRLQLEAVNITDLSENRKQDKRFAFIRSDSGPTTSFESAAC[S-maleimide-(CH$_2$)$_4$-

NH-(N$^\alpha$-(HOOC(CH$_2$)$_{14}$CO)-γ-Glu)]PGWFLCTAMEADQPVSLTNMPDEGVMVTK

FYFQEDE(S is the sulphur atom on the side chain of a cysteine residue);

G-30:

(SEQ ID NO: 30)

HGEGTFTSDLSKQMEEEAVRLFIEWLKNGGPSSGAPPPC(S-maleimide-(CH$_2$)$_{15}$-COOH)GG

GGSGGGGSRPSGRKSSKMQAFRIWDVNQKTFYLRNNQLVAGYLQGPNVNLEEKIDVVPI

EPHALFLGIHGGKMCLSCVKSGDETRLQLEAVNITDLSENRKQDKRFAFIRSDSGPTTSFE

SAASPGWFLCTAMEADQPVSLTNMPDEGVMVTKFYFQEDE(S is the sulphur atom on the side chain of a cysteine residue);

G-31:
(SEQ ID NO: 31)
HGEGTFTSDLSKQMEEEAVRLFIEWLKNGGPSSGAPPPC(S-maleimide-(CH$_2$)$_{17}$-COOH)GG

GGSGGGGSRPSGRKSSKMQAFRIWDVNQKTFYLRNNQLVAGYLQGPNVNLEEKIDVVPI

EPHALFLGIHGGKMCLSCVKSGDETRLQLEAVNITDLSENRKQDKRFAFIRSDSGPTTSFE

SAASPGWFLCTAMEADQPVSLTNMPDEGVMVTKFYFQEDE(S is the sulphur atom on the side chain of a cysteine residue);

G-32:
(SEQ ID NO: 32)
HGEGTFTSDLSKQMEEEAVRLFIEWLKNGGPSSGAPPPC[S-CH$_2$-CONH-(CH$_2$CH$_2$O)$_2$-(CH$_2$)$_2$-

NH-(N$^\alpha$-(HOOC(CH$_2$)$_{14}$CO)-γ-Glu)]-GGGGSGGGGSRPSGRKSSKMQAFRIWDVNQKTF

YLRNNQLVAGYLQGPNVNLEEKIDVVPIEPHALFLGIHGGKMCLSCVKSGDETRLQLEA

VNITDLSENRKQDKRFAFIRSDSGPTTSFESAASPGWFLCTAMEADQPVSLTNMPDEGV

MVTKFYFQEDE(S is the sulphur atom on the side chain of a cysteine residue);

G-33:
(SEQ ID NO: 33)
HGEGTFTSDLSKQMEEEAVRLFIEWLC[S-CH$_2$-CONH-(CH$_2$CH$_2$O)$_2$-(CH$_2$)$_2$-NH-(N$^\alpha$-(HOOC (CH$_2$)$_{14}$CO)-γ-Glu)]NGGPSSGAPPPSGGGGSGGGGSRPSGRKSSKMQAFRIWDVNQKTF

YLRNNQLVAGYLQGPNVNLEEKIDVVPIEPHALFLGIHGGKMCLSCVKSGDETRLQLEA

VNITDLSENRKQDKRFAFIRSDSGPTTSFESAASPGWFLCTAMEADQPVSLTNMPDEGV

MVTKFYFQEDE(S is the sulphur atom on the side chain of a cysteine residue);

G-34:
(SEQ ID NO: 34)
HGEGTFTSDLSKQMEEEAVC[S-CH$_2$-CONH-(CH$_2$CH$_2$O)$_2$-(CH$_2$)$_2$-NH-(N$^\alpha$-(HOOC(CH$_2$)$_{14}$CO)-

γ-Glu)]LFIEWLKNGGPSSGAPPPSGGGGSGGGGSRPSGRKSSKMQAFRIWDVNQKTF

YLRNNQLVAGYLQGPNVNLEEKIDVVPIEPHALFLGIHGGKMCLSCVKSGDETRLQLEA

VNITDLSENRKQDKRFAFIRSDSGPTTSFESAASPGWFLCTAMEADQPVSLTNMPDEGV

MVTKFYFQEDE(S is the sulphur atom on the side chain of a cysteine residue);

G-35:
(SEQ ID NO: 35)
HGEGTFTSDLSKQMEEEAVRLFIEWLKNGGPC[S-CH$_2$-CONH-(CH$_2$CH$_2$O)$_2$-(CH$_2$)$_2$-NH- (N$^\alpha$-(HOOC(CH$_2$)$_{14}$CO)-γ-Glu)]SGAPPPSGGGGSGGGGSRPSGRKSSKMQAFRIWDVNQKTF

YLRNNQLVAGYLQGPNVNLEEKIDVVPIEPHALFLGIHGGKMCLSCVKSGDETRLQLEA

VNITDLSENRKQDKRFAFIRSDSGPTTSFESAASPGWFLCTAMEADQPVSLTNMPDEGV

MVTKFYFQEDE(S is the sulphur atom on the side chain of a cysteine residue);

G-36:
(SEQ ID NO: 36)
HGEGTFTSDLSKQMEEEAVRLFIEWLKNGGPSSGAPPPSGGGGSGGGGSRPSGRKSSKM

QAFRIWDVNQKTFYLRNNQLVAGYLQGPNVNLEEKIDVVPIEPHALFLGIHGGKMCLSC

VKSGDETRLQLEAVC(S-maleimide-(CH$_2$)$_{15}$-COOH)ITDLSENRKQDKRFAFIRSDSGPT

TSFESAASPGWFLCTAMEADQPVSLTNMPDEGVMVTKFYFQEDE(S is the sulphur atom on the side chain of a cysteine residue);

G-37:
(SEQ ID NO: 37)
HGEGTFTSDLSKQMEEEAVRLFIEWLKNGGPSSGAPPPSGGGGSGGGGSRPSGRKSSKM

QAFRIWDVNQKTFYLRNNQLVAGYLQGPNVNLEEKIDVVPIEPHALFLGIHGGKMCLSC

VKSGDETRLQLEAVC[S-CH$_2$-CONH-(CH$_2$CH$_2$O)$_2$-(CH$_2$)$_2$-NH-(N$^\alpha$-(HOOC(CH$_2$)$_{14}$CO)-γ-

-continued

Glu)]ITDLSENRKQDKRFAFIRSDSGPTTSFESAASPGWFLCTAMEADQPVSLTNMPDEGVMV

TKFYFQEDE($\underline{S}$ is the sulphur atom on the side chain of a cysteine residue);

G-38: (SEQ ID NO: 38)

HGEGTFTSDLSKQMEEEAVRLFIEWLKNGGPSSGAPPPSGGGGSGGGGSRPSGRKSSKM

QAFRIWDVNQKTFYLRNNQLVAGYLQGPNVNLEEKIDVVPIEPHALFLGIHGGKMCLSC

VKSGDETRLQLEAVNITDLSENRKQDKRFAFIRSDSGPTTSFESAAC(S-maleimide-$(CH_2)_{17}$-

COOH)-PGWFLCTAMEADQPVSLTNMPDEGVMVTKFYFQEDE(S is the sulphur atom on the side chain of a cysteine residue);

G-39: (SEQ ID NO: 39)

HGEGTFTSDLSKQMEEEAVRLFIEWLKNGGPSSGAPPPSGGGGSGGGGSRPSGRKSSKM

QAFRIWDVNQKTFYLRNNQLVAGYLQGPNVNLEEKIDVVPIEPHALFLGIHGGKMCLSC

VKSGDETRLQLEAVNITDLSENRKQDKRFAFIRSDSGPTTSFESAAC[$\underline{S}$-$CH_2$-CONH-$(CH_2CH_2O)_4$-

$(CH_2)_2$-NH-$(N^\alpha$-$(HOOC(CH_2)_{16}CO)$-$\gamma$-Glu)]-PGWFLCTAMEADQPVSLTNMPDEGVM VTKFYFQEDE($\underline{S}$ is the sulphur atom on the side chain of a cysteine residue);

G-40: (SEQ ID NO: 40)

HGEGTFTSDVSSYLEEQAAKEFIAWLVKGRC($\underline{S}$-maleimide-$(CH_2)_{15}$-COOH)GGGGSGG

GGSRPSGRKSSKMQAFRIWDVNQKTFYLRNNQLVAGYLQGPNVNLEEKIDVVPIEPHAL

FLGIHGGKMCLSCVKSGDETRLQLEAVNITDLSENRKQDKRFAFIRSDSGPTTSFESAASP

GWFLCTAMEADQPVSLTNMPDEGVMVTKFYFQEDE($\underline{S}$ is the sulphur atom on the side chain of a cysteine residue);

G-41: (SEQ ID NO: 41)

HGEGTFTSDVSSYLEEQAAKEFIAWLVKGRC[$\underline{S}$-$CH_2$-CONH-$(CH_2CH_2O)_2$-$(CH_2)_2$-NH-$(N^\alpha$-

$(HOOC(CH_2)_{14}CO)$-$\gamma$-Glu)]GGGGSGGGGSRPSGRKSSKMQAFRIWDVNQKTFYLRNNQLV

AGYLQGPNVNLEEKIDVVPIEPHALFLGIHGGKMCLSCVKSGDETRLQLEAVNITDLSEN

RKQDKRFAFIRSDSGPTTSFESAASPGWFLCTAMEADQPVSLTNMPDEGVMVTKFYFQE

DE($\underline{S}$ is the sulphur atom on the side chain of a cysteine residue);

G-42: (SEQ ID NO: 42)

HGEGTFTSDVSSYLEEQAAKEFIAWLYKGRGGGGSGGGGSRPSGRKSSKMQAERIWDY

NQKTFYLRNNQLVAGYLQGPNVNLEEKIDVVPIEPHALFLGIHGGKMCLSCVKSGDETR

LQLEAVC($\underline{S}$-maleimide-$(CH_2)_{17}$-COOH)ITDLSENRKQDKRFAFIRSDSGPTTSFESAASPG WFLCTAMEADQPVSLTNMPDEGVMVTKFYFQEDE($\underline{S}$ is the sulphur atom on the side chain of a cysteine residue);

G-43: (SEQ ID NO: 43)

HGEGTFTSDVSSYLEEQAAC[$\underline{S}$-$CH_2$-CONH-$(CH_2CH_2O)_2$-$(CH_2)_2$-NH-$(N^\alpha$-$(HOOC(CH_2)_{14}$ CO)-$\gamma$-Glu)]EFIAWLYKGRGGGGSGGGGSRPSGRKSSKMQAFRIWDYNQKTFYLRNNQLV

AGYLQGPNVNLEEKIDVVPIEPHALFLGIHGGKMCLSCVKSGDETRLQLEAVNITDLSEN

RKQDKRFAFIRSDSGPTTSFESAASPGWELCTAMEADQPVSLTNMPDEGVMVTKFYFQE

DE($\underline{S}$ is the sulphur atom on the side chain of a cysteine residue);

G-44: (SEQ ID NO: 44)

HAEGTFTSDVSSYLEGQAAC[$\underline{S}$-$CH_2$-CONH-$(CH_2CH_2O)_2$-$(CH_2)_2$-NH-$(N^\alpha$-$(HOOC(CH_2)_{14}$ CO)-$\gamma$-Glu)]EFIAWLYKGRGGGGSGGGGSRPSGRKSSKMQAFRIWDYNQKTFYLRNNQLY -continued

AGYLQGPNVNLEEKIDVVPIEPHALFLGIHGGKMCLSCVKSGDETRLQLEAVNITDLSEN

RKQDKRFAFIRSDSGPTTSFESAASPGWFLCTAMEADQPVSLTNMPDEGVMVTKFYFQE

DE($S$ is the sulphur atom on the side chain of a cysteine residue);

G-45:

(SEQ ID NO: 45)

HGEGTFTSDC[$S$-CH$_2$-CONH-(CH$_2$CH$_2$O)$_2$-(CH$_2$)$_2$-NH-(N$^\alpha$-(HOOC(CH$_2$)$_{14}$CO-γ-Glu-N-γ-Glu)]

SSYLEEQAAKEFIAWLYKGRGGGGSGGGGSRPSGRKSSKMQAFRIWDYNQKTFYLRN

NQLVAGYLQGPNVNLEEKIDVVPIEPHALFLGIHGGKMCLSCVKSGDETRLQLEAVNITD

LSENRKQDKRFAFIRSDSGPTTSFESAASPGWFLCTAMEADQPVSLTNMPDEGVMVTKF

YFQEDE($S$ is the sulphur atom on the side chain of a cysteine residue);

G-46:

(SEQ ID NO: 46)

HAEGTFTSDC[$S$-CH$_2$-CONH-(CH$_2$CH$_2$O)$_2$-(CH$_2$)$_2$-NH-(N$^\alpha$-(HOOC(CH$_2$)$_{14}$CO)-γ-Glu)]SSYL

EGQAAKEFIAWLYKGRGGGGSGGGGSRPSGRKSSKMQAFRIWDYNQKTFYLRNNQLVA

GYLQGPNVNLEEKIDVVPIEPHALFLGIHGGKMCLSCVKSGDETRLQLEAVNITDLSENR

KQDKRFAFIRSDSGPTTSFESAASPGWFLCTAMEADQPVSLTNMPDEGVMVTKFYFQED

E($S$ is the sulphur atom on the side chain of a cysteine residue);

G-47:

(SEQ ID NO: 47)

HGEGTFTSDVSSYLEEQAAKEFIAWLYC[$S$-CH$_2$-CONH-(CH$_2$CH$_2$O)$_2$-(CH$_2$)$_2$-NH-(N$^\alpha$-(HOOC (CH$_2$)$_{14}$CO)-γ-Glu)]GRGGGGSGGGGSRPSGRKSSKMQAFRIWDYNQKTFYLRNNQLY

AGYLQGPNVNLEEKIDVVPIEPHALFLGIHGGKMCLSCVKSGDETRLQLEAVNITDLSEN

RKQDKRFAFIRSDSGPTTSFESAASPGWFLCTAMEADQPVSLTNMPDEGVMVTKFYFQE

DE($S$ is the sulphur atom on the side chain of a cysteine residue);

G-48:

(SEQ ID NO: 48)

HGEGTFTSDVSSYLEEQAAKEFIAWLVKGRGGGGSGGGGSRPSGRKSSKMQAERIWDV

NQKTFYLRNNQLVAGYLQGPNVNLEEKIDVVPIEPHALFLGIHGGKMCLSCVKSGDETR

LQLEAVC[$S$-CH$_2$-CONH-(CH$_2$CH$_2$O)$_4$-(CH$_2$)$_2$-NH-(N$^\alpha$-(HOOC(CH$_2$)$_{16}$CO)-γ-Glu)]ITDLSEN

RKQDKRFAFIRSDSGPTTSFESAASPGWFLCTAMEADQPVSLTNMPDEGVMVTKFEYFQE

DE($S$ is the sulphur atom on the side chain of a cysteine residue);

G-49:

(SEQ ID NO: 49)

HGEGTFTSDVSSYLEEQAAKEFIAWLVKGRGGGGSGGGGSRPSGRKSSKMQAPRIWDV

NQKTFYLRNNQLVAGYLQGPNVNLEEKIDVVPIEPHALFLGIHGGKMCLSCVKSGDETR

LQLEAVNITDLSENRKQDKRFAFIRSDSGPTTSFESAAC($S$-maleimide-(CH$_2$)$_{15}$-COOH)PGW

FLCTAMEADQPVSLTNMPDEGVMVTKFYFQEDE($S$ is the sulphur atom on the side chain of a cysteine residue);

G-50:

(SEQ ID NO: 50)

HGEGTFTSDVSSYLEEQAAKEFIAWLVKGRGGGGSGGGGSRPSGRKSSKMQAERIWDV

NQKTFYLRNNQLVAGYLQGPNVNLEEKIDVVPIEPHALFLGIHGGKMCLSCVKSGDETR

LQLEAVNITDLSENRKQDKRFAFIRSDSGPTTSFESAAC[$S$-CH$_2$-CONH-(CH$_2$CH$_2$O)$_2$-(CH$_2$)$_2$-

NH-(N$^\alpha$-(HOOC(CH$_2$)$_{14}$CO)-γ-Glu)]PGWFLCTAMEADQPVSLTNMPDEGVMVTKFYFQE DE($S$ is the sulphur atom on the side chain of a cysteine residue);

G-51:

(SEQ ID NO: 51)
RPSGRKSSKMQAFRIWDVNQKTFYLRNNQLVAGYLQGPNVNLEEKIDVVPIEPHALFLGI

HGGKMCLSCVKSGDETRLQLEAVC(S-maleimide-PEG11-maleimide-S-GLP-1 receptor binding polypeptide)

ITDLSENRKQDKRFAFIRSDSGPTTSFESAASPGWFLCTAMEADQPVSLTNMPDE

GVMVTKFYFQEDE(S is the sulphur atom on the side chain of a cysteine residue), wherein the GLP-1 receptor binding polypeptide has the following sequence: HGEGTFTSDLSKQMEEEAVR-LFIEWLKNGGPSSGAPPPC (SEQ ID NO:185) and is linked to the interleukin-1 receptor antagonistic protein by reacting the mercapto group on the side chain of a terminal cysteine residue with the maleimide;

G-52:

(SEQ ID NO: 52)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSFESAAC (S-maleimide-PEG11-maleimide-S-GLP-1 receptor binding polypeptide)

PGWFLCTAMEADQPVSLT NMPDEGVMVTKFYFQEDE(S is the sulphur atom on the side chain of a cysteine residue), wherein the GLP-1 receptor binding polypeptide has the sequence of SEQ ID NO: 185 and is linked to the interleukin-1 receptor antagonistic protein by reacting the mercapto group on the side chain of a terminal cysteine residue with the maleimide;

G-53:

(SEQ ID NO: 53)
RPSGRKSSKMQAFRIWDVNQKTFYLRNNQLVAGYLQGPNVNLEEKIDVVP

IEPHALFLGIHGGKMCLSCVKSGDETRLQLEAVC(S-maleimide-

PEG11-maleimide-S-GLP-1 receptor binding polypeptide)ITDLSENRKQDKRFAFIRSDSGPTTSFESAASPGWFLC TAMEADQPVSLTNMPDEGVMVTKFYFQEDE(S is the sulphur atom on the side chain of a cysteine residue), wherein the GLP-1 receptor binding polypeptide has the following sequence: HGEGTFTSDVSSYLEEQAAKEFI-AWLVKGRC(SEQ ID NO: 186) and is linked to the interleukin-1 receptor antagonistic protein by reacting the mercapto group on the side chain of a terminal cysteine residue with the maleimide;

G-54:

(SEQ ID NO: 54)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSFESAAC (S-maleimide-PEG11-maleimide-S-

GLP-1 receptor binding polypeptide)PGWFLCTAMEADQPV

SLT NMPDEGVMVTKFYFQEDE(S is the sulphur atom on the side chain of a cysteine residue), wherein the GLP-1 receptor binding polypeptide has the sequence of SEQ ID NO: 186 and is linked to the interleukin-1 receptor antagonistic protein by reacting the mercapto group on the side chain of a terminal cysteine residue with the maleimide;

G-55:

(SEQ ID NO: 55)
RPSGRKSSKMQAFRIWDVNQKTFYLRNNQLVAGYLQGPNVNLEEKIDVVP

IEPHALFLGIHGGKMCLSCVKSGDETRLQLEAVC(S-maleimide-

PEG11-maleimide-S-GLP-1 receptor binding polypeptide)ITDLSENRKQDKRFAFIRSDSGPTTSFESAASPGWFLC TAMEADQPVSLTNMPDEGVMVTKFYFQEDE(S is the sulphur atom on the side chain of a cysteine residue), wherein the GLP-1 receptor binding polypeptide has the following sequence:

(SEQ ID NO: 187)
HGEGTFTSDVSSYLEEQAAKEFIAWLVCGRG and is linked to the interleukin-1 receptor antagonistic protein by reacting the mercapto group on the side chain of a cysteine residue with the maleimide;

G-56:

(SEQ ID NO: 56)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSFESAAC
(S-maleimide-PEG11-maleimide-S-GLP-1
receptor binding polypeptide)

PGWFLCTAMEADQPVSLTNM PDEGVMVTKFYFQEDE
(S is the sulphur atom on the side chain
of a cysteine residue), wherein the GLP-1 receptor binding polypeptide has the sequence of SEQ ID NO:187 and is linked to the interleukin-1 receptor antagonistic protein by reacting the mercapto group on the side chain of a cysteine residue with the maleimide;

G-57:
(SEQ ID NO: 57)
RPSGRKSSKMQAFRIWDVNQKTFYLRNNQLVAGYLQGPNVNLEEKIDVVP

IEPHALFLGIHGGKMCLSCVKSGDETRLQLEAVC
(S-maleimide-PEG11-maleimide-S-GLP-1 receptor
binding polypeptide)

ITDLSENRKQDKRFAFIRSDSGPTTSFESAASPGWFLCTAMEADQPVSLT

NMPDE GVMVTKFYFQEDE
(S is the sulphur atom on the side chain
of a cysteine residue), wherein the GLP-1 receptor binding polypeptide has the following sequence: HGEGTFTSDLSKQMEEEAVR-LFIEWLCNGGPSSGAPPPS (SEQ ID NO:188) and is linked to the interleukin-1 receptor antagonistic protein by reacting the mercapto group on the side chain of a cysteine residue with the maleimide;

G-58:
(SEQ ID NO: 58)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSFESAAC
(S-maleimide-PEG11-maleimide-S-GLP-1 receptor
binding polypeptide)

PGWFLCTAMEADQPVSLTN-MPDEGVMVTKFYFQEDE
(S is the sulphur atom on the side chain
of a cysteine residue), wherein the the GLP-1 receptor binding polypeptide has the sequence of SEQ ID NO: 188 and is linked to the interleukin-1 receptor antagonistic protein by reacting the mercapto group on the side chain of a cysteine residue with the maleimide;

G-59:
(SEQ ID NO: 59)
RPSGRKSSKMQAFRIWDVNQKTFYLRNNQLVAGYLQGPNVNLEEKIDVVP

IEPHALFLGIHGGKMCLSCVKSGDETRLQLEAVC
(S-maleimide-PEG20K-maleimide-S-GLP-1 receptor
binding polypeptide)

ITDLSENRKQDKRFAFIRSDSGPTTSFESAASPGWFLCTAMEADQPVSLT

NMPDE GVMVTKFYFQEDE
(S is the sulphur atom on the side chain
of a cysteine residue), wherein the GLP-1 receptor binding polypeptide has the sequence of SEQ ID NO: 185 and is linked to the interleukin-1 receptor antagonistic protein by reacting the mercapto group on the side chain of a terminal cysteine residue with the maleimide;

G-60:
(SEQ ID NO: 60)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSFESAAC
(S-maleimide-PEG20K-maleimide-S-GLP-1 receptor
binding polypeptide)

PGWFLCTAMEADQPVSLT NMPDEGVMVTKFYFQEDE
(S is the sulphur atom on the side chain
of a cysteine residue), wherein the GLP-1 receptor binding polypeptide has the sequence of SEQ ID NO: 185 and is linked to the interleukin-1 receptor antagonistic protein by reacting the mercapto group on the side chain of a terminal cysteine residue with the maleimide;

G-61:
(SEQ ID NO: 61)
RPSGRKSSKMQAFRIWDVNQKTFYLRNNQLVAGYLQGPNVNLEEKIDVVP

IEPHALFLGIHGGKMCLSCVKSGDETRLQLEAVC
(S-maleimide-PEG20K-maleimide-S-GLP-1 receptor
binding polypeptide)

ITDLSENRKQDKRFAFIRSDSGPTTSFESAASPGWFLCTAMEADQPVSLT

NMPD EGVMVTKFYFQEDE
(S is the sulphur atom on the side chain
of a cysteine residue), wherein the GLP-1 receptor binding polypeptide has the following sequence:

(SEQ ID NO: 189)
HAibEGTFTSDVSSYLEGQAAKEFIAWLVKGRC and is linked to the interleukin-1 receptor antagonistic protein by reacting the mercapto group on the side chain of a terminal cysteine residue with the maleimide;

G-62:
(SEQ ID NO: 62)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSFESAAC
(S-maleimide-PEG20K-maleimide-S-GLP-1 receptor
binding polypeptide)

PGWFLCTAMEADQPVSLT NMPDEGVMVTKFYFQEDE
(S is the sulphur atom on the side chain
of a cysteine residue), wherein the GLP-1 receptor binding polypeptide has the sequence of SEQ ID NO: 186 and is linked to the interleukin-1 receptor antagonistic protein by reacting the mercapto group on the side chain of a terminal cysteine residue with the maleimide;

G-63:
(SEQ ID NO: 63)
RPSGRKSSKMQAFRIWDVNQKTFYLRNNQLVAGYLQGPNVNLEEKIDVVP

IEPHALFLGIHGGKMCLSCVKSGDETRLQLEAVC
(S-maleimide-PEG20K-maleimide-S-GLP-1 receptor
binding polypeptide)

ITDLSENRKQDKRFAFIRSDSGPTTSFESAASPGWFLCTAMEADQPVSLT

NMPDEGVMVTKFYFQEDE
(S is the sulphur atom on the side chain
of a cysteine residue), wherein the GLP-1 receptor binding polypeptide has the sequence of SEQ ID NO: 187 and is linked to the interleukin-1 receptor antagonistic protein by reacting the mercapto group on the side chain of a cysteine residue with the maleimide;

G-64:
(SEQ ID NO: 64)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSFESAAC
(S-maleimide-PEG20K-maleimide-S-GLP-1 receptor
binding polypeptide)

PGWFLCTAMEADQPVSLTNMPD EGVMVTKFYFQEDE
(S is the sulphur atom on the side chain
of a cysteine residue), wherein the GLP-1 receptor binding polypeptide has the following sequence:

(SEQ ID NO: 190)
HAibEGTFTSDVSSYLEGQAAKEFIAWLVCGRG and is linked to the interleukin-1 receptor antagonistic protein by reacting the mercapto group on the side chain of a cysteine residue with the maleimide;

G-65:
(SEQ ID NO: 65)
RPSGRKSSKMQAFRIWDVNQKTFYLRNNQLVAGYLQGPNVNLEEKIDVVP

IEPHALFLGIHGGKMCLSCVKSGDETRLQLEAVC
(S-maleimide-PEG20K-maleimide-S-GLP-1 receptor
binding polypeptide)

ITDLSENRKQDKRFAFIRSDSGPTTSFESAASPGWFLCTAMEADQPVSLT

NMPD EGVMVTKFYFQEDE
(S is the sulphur atom on the side chain
of a cysteine residue), wherein the GLP-1 receptor binding polypeptide has the sequence of SEQ ID NO: 188 and is linked to the interleukin-1 receptor antagonistic protein by reacting the mercapto group on the side chain of a cysteine residue with the maleimide;

G-66:
(SEQ ID NO: 66)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSFESAAC
(S-maleimide-PEG20K-maleimide-S-GLP-1 receptor
binding polypeptide)

PGWFLCTAMEADQPVSLTN-MPDEGVMVTKFYFQEDE
(S is the sulphur atom on the side chain
of a cysteine residue), wherein the GLP-1 receptor binding polypeptide has the sequence of SEQ ID NO: 188 and is linked to the interleukin-1 receptor antagonistic protein by reacting the mercapto group on the side chain of a cysteine residue with the maleimide;

G-67:
(SEQ ID NO: 67)
(GLP-1 receptor binding polypeptide-S-
maleimide-PEG20K-maleimide-S)
CRPSGRKSSKMQAPRIWDVNQKTFYLRNNQLVAGYLQGPNVNLEEKIDVV

PIEPHALFLGIHGGKMCLSCVKSGDETRLQLEAVNITDLSENRKQDKRFA

-continued
FIRSDSGPTTSFESAASPGWELCTAMEADQPVSLTNMPDEGVMVTKFYFQ

EDE
(S is the sulphur atom on the side chain
of a cysteine residue), wherein the GLP-1 receptor binding polypeptide has the sequence of SEQ ID NO: 185 and is linked to the interleukin-1 receptor antagonistic protein by reacting the mercapto group on the side chain of a terminal cysteine residue with the maleimide;

G-68:
(SEQ ID NO: 68)
(PEG20K)RPSGRKSSKMQAFRIWDVNQKTFYLRNNQLVAGYLQGPNVNL

EEKIDVVPIEPHALFLGIHGGKMCLSCVKSGDETRLQLEAVNITDLSENR

KQDKRFAFIRSDSGPTTSFESAAC
(S-maleimide-PEG11-maleimide-S-GLP-1 receptor
binding polypeptide)

PGWFLCTAMEADQPVSLTNMPDEGVMVTKFYFQEDE
(S is the sulphur atom on the side chain
of a cysteine residue), wherein the GLP-1 receptor binding polypeptide has the sequence of SEQ ID NO: 185 and is linked to the interleukin-1 receptor antagonistic protein by reacting the mercapto group on the side chain of a terminal cysteine residue with the maleimide;

G-69:
(SEQ ID NO: 69)
(PEG20K)RPSGRKSSKMQAFRIWDVNQKTFYLRNNQLVAGYLQGPN

VNLEEKIDVVPIEPHALFLGIHGGKMCLSCVKSGDETRLQLEAVC
(S-maleimide-PEG11-maleimide-S-GLP-1 receptor
binding polypeptide)

ITDLSENRKQDKRFAFIRSDSGPTTSFESAASPGWFLCTAMEADQPV

SLTNMPDEGVMVTKFYFQEDE,
(S is the sulphur atom on the side chain of a
cysteine residue)

G-69:
wherein the GLP-1 receptor binding polypeptide has the sequence of SEQ ID NO: 186 and is linked to the interleukin-1 receptor antagonistic protein by reacting the mercapto group on the side chain of a terminal cysteine residue with the maleimide;

G-70:
(SEQ ID NO: 70)
(GLP-1 receptor binding polypeptide-S-maleimide-
PEG20K-maleimide-S)

CRPSGRKSSKMQAPRIWDVNQKTFYLRNNQLVAGYLQGPNVNLEEKI

DVVPIEPHALFLGIHGGKMCLSCVKSGDETRLQLEAVNITDLSENRK

QDKRFAFIRSDSGPTTSFESAASPGWFLCTAMEADQPVSLTNMPDEG

VMVTKFYFQEDE,
(S is the sulphur atom on the side chain of a
cysteine residue)

wherein the GLP-1 receptor binding polypeptide has the sequence of SEQ ID NO: 189 and is linked to the interleukin-1 receptor antagonistic protein by reacting the mercapto group on the side chain of a terminal cysteine residue with the maleimide;

G-71:
(SEQ ID NO: 71)
RPSGRKSSKMQAFRIWDVNQKTFYLRNNQLVAGYLQGPNVNLEEKID

VVPIEPHALFLGIHGGKMCLSCVKSGDETRLQLEAVC
(*S*-maleimide-PEG11-maleimide-*S*-GLP-1 receptor
binding polypeptide)

ITDLSENRKQDKRFAFIRSDSGPTTSFESAASPGWFLCTAMEADQPV

SLTNMPDEGVMVTKFYFQEDE,
(*S* is the sulphur atom on the side chain of a
cysteine residue)

wherein the GLP-1 receptor binding polypeptide has the following sequence:

(SEQ ID NO: 191)
HAibEGTFTSDVSSYLEEQAAKEFIAWLVKGRC and is linked to the interleukin-1 receptor antagonistic protein by reacting the mercapto group on the side chain of a terminal cysteine residue with the maleimide;

G-72:
(SEQ ID NO: 72)
RPSGRKSSKMQAFRIWDVNQKTFYLRNNQLVAGYLQGPNVNLEEKQI

DVVPIEPHALFLGIHGGKMCLSCVKSGDETRLLEAVNITDLSENRKQ

DKRFAFIRSDSGPTTSFESAAC
(*S*-maleimide-PEG11-maleimide-*S*-GLP-1 receptor
binding polypeptide)

PGWFLCTAMEADQPVSLTNMPDEGVMVTKFYFQEDE,
(*S* is the sulphur atom on the side chain of a
cysteine residue)

wherein the GLP-1 receptor binding polypeptide has the sequence of SEQ ID NO: 191 and is linked to the interleukin-1 receptor antagonistic protein by reacting the mercapto group on the side chain of a terminal cysteine residue with the maleimide;

G-73:
(SEQ ID NO: 73)
RPSGRKSSKMQAFRIWDVNQKTFYLRNNQLVAGYLQGPNVNLEEKID

VVPIEPHALFLGIHGGKMCLSCVKSGDETRLQLEAVC
(*S*-maleimide-PEG11-maleimide-*S*-GLP-1 receptor
binding polypeptide)

ITDLSENRKQDKRFAFIRSDSGPTTSFESAASPGWFLCTAMEADQPV

SLTNMPDEGVMVTKFYFQEDE,
(*S* is the sulphur atom on the side chain of a
cysteine residue)

wherein the GLP-1 receptor binding polypeptide has the sequence of SEQ ID NO:189 and is linked to the interleukin-1 receptor antagonistic protein by reacting the mercapto group on the side chain of a terminal cysteine residue with the maleimide;

G-74:
(SEQ ID NO: 74)
RPSGRKSSKMQAFRIWDVNQKTFYLRNNQLVAGYLQGPNVNLEEKID

VVPIEPHALFLGIHGGKMCLSCVKSGDETRLQLEAVNITDLSENRKQ

DKRFAFIRSDSGPTTSFESAAC
(*S*-maleimide-PEG11-maleimide-*S*-GLP-1 receptor
binding polypeptide)

PGWFLCTAMEADQPVSLTNMPDEGVMVTKFYFQEDE,
(*S* is the sulphur atom on the side chain of a
cysteine residue)

wherein the GLP-1 receptor binding polypeptide has the sequence of SEQ ID NO:189 and is linked to the interleukin-1 receptor antagonistic protein by reacting the mercapto group on the side chain of a terminal cysteine residue with the maleimide;

G-75:
(SEQ ID NO: 75)
RPSGRKSSKMQAFRIWDVNQKTFYLRNNQLVAGYLQGPNVNLEEKID

VVPIEPHALFLGIHGGKMCLSCVKSGDETRLQLEAVC
(*S*-maleimide-PEG11-maleimide-*S*-GLP-1 receptor
binding polypeptide)

ITDLSENRKQDKRFAFIRSDSGPTTSFESAASPGWFLCTAMEADQPV

SLTNMPDEGVMVTKFYFQEDE,
(*S* is the sulphur atom on the side chain of a
cysteine residue)

wherein the GLP-1 receptor binding polypeptide has the sequence of SEQ ID NO: 190 and is linked to the interleukin-1 receptor antagonistic protein by reacting the mercapto group on the side chain of a cysteine residue with the maleimide;

G-76:
(SEQ ID NO: 76)
RPSGRKSSKMQAFRIWDVNQKTFYLRNNQLVAGYLQGPNVNLEEKID

VVPIEPHALFLGIHGGKMCLSCVKSGDETRLQLEAVNITDLSENRKQ

DKRFAFIRSDSGPTTSFESAAC
(*S*-maleimide-PEG11-maleimide-*S*-GLP-1 receptor
binding polypeptide)

PGWFLCTAMEADQPVSLTNMPDEGVMVTKFYFQEDE,
(*S* is the sulphur atom on the side chain of a
cysteine residue)

wherein the GLP-1 receptor binding polypeptide has the sequence of SEQ ID NO: 190 and is linked to the interleukin-1 receptor antagonistic protein by reacting the mercapto group on the side chain of a cysteine residue with the maleimide;

G-77:
(SEQ ID NO: 77)
RPSGRKSSKMQAFRIWDVNQKTFYLRNNQLVAGYLQGPNVNLEEKID

VVPIEPHALFLGIHGGKMCLSCVKSGDETRLQLEAVC
(*S*-maleimide-PEG11-maleimide-*S*-GLP-1 receptor
binding polypeptide)

ITDLSENRKQDKRFAFIRSDSGPTTSFESAASPGWFLCTAMEADQPV

SLTNMPDEGVMVTKFYFQEDE,
(*S* is the sulphur atom on the side chain of a
cysteine residue)

wherein the GLP-1 receptor binding polypeptide has the following sequence:

(SEQ ID NO: 192)
HAibEGTFTSDVSSYLEGQAACEFIAWLVKGRG and is linked to the interleukin-1 receptor antagonistic protein by reacting the mercapto group on the side chain of a cysteine residue with the maleimide;

G-78:
(SEQ ID NO: 78)
RPSGRKSSKMQAFRIWDVNQKTFYLRNNQLVAGYLQGPNVNLEEKID

VVPIEPHALFLGIHGGKMCLSCVKSGDETRLQLEAVNITDLSENRKQ

DKRFAFIRSDSGPTTSFESAAC
(S-maleimide-PEG11-maleimide-S-GLP-1 receptor binding polypeptide)

PGWFLCTAMEADQPVSLTN-MPDEGVMVTKFYFQEDE,
(S is the sulphur atom on the side chain of a cysteine residue)

wherein the GLP-1 receptor binding polypeptide has the sequence of SEQ ID NO: 192 and is linked to the interleukin-1 receptor antagonistic protein by reacting the mercapto group on the side chain of a cysteine residue with the maleimide;

G-79:
(SEQ ID NO: 79)
RPSGRKSSKMQAFRIWDVNQKTFYLRNNQLVAGYLQGPNVNLEEKID

VVPIEPHALFLGIHGGKMCLSCVKSGDETRLQLEAVC
(S-maleimide-PEG11-maleimide-S-GLP-1 receptor binding polypeptide)

ITDLSENRKQDKRFAFIRSDSGPTTSFESAASPGWFLCTAMEADQPV

SLTNMPDEGVMVTKFYFQEDE,
(S is the sulphur atom on the side chain of a cysteine residue)

wherein the GLP-1 receptor binding polypeptide has the following sequence:

(SEQ ID NO: 193)
HAEGTFTSDVSSYLEGQAAK[N$^{\epsilon}$-(N$^{\alpha}$-(HOOC(CH$_2$)$_{14}$CO)-

γ-L-Glu)]EFIAWLVRGRC and is linked to the interleukin-1 receptor antagonistic protein by reacting the mercapto group on the side chain of a terminal cysteine residue with the maleimide;

G-80:
(SEQ ID NO: 80)
RPSGRKSSKMQAFRIWDVNQKTFYLRNNQLVAGYLQGPNVNLEEKID

VVPIEPHALFLGIHGGKMCLSCVKSGDETRLQLEAVNITDLSENRKQ

DKRFAFIRSDSGPTTSFESAAC
(S-maleimide-PEG11-maleimide-S-GLP-1 receptor binding polypeptide)

PGWFLCTAMEADQPVSLTN-MPDEGVMVTKFYFQEDE,
(S is the sulphur atom on the side chain of a cysteine residue)

wherein the GLP-1 receptor binding polypeptide has the sequence of SEQ ID NO: 193 and is linked to the interleukin-1 receptor antagonistic protein by reacting the mercapto group on the side chain of a terminal cysteine residue with the maleimide;

G-81:
(SEQ ID NO: 81)
HGEGTFTSDLSKQMEEEAVRLFIEWLKNGGPSSGAPPPSGGGGSGGG

GSDAHKSEVAHRFKDLGEENFKALVLIAFAQYLQQCPFEDHVKLVNE

VTEFAKTCVADESAENCDKSLHTLFGDKLCTVATLRETYGEMADCCA

KQEPERNECFLQHKDDNPNLPRLVRPEVDVMCTAFHDNEETFLKKYL

YEIARRHPYFYAPELLFFAKRYKAAFTECCQAADKAACLLPKLDELR

DEGKASSAKQRLKCASLQKFGERAFKAWAVARLSQRFPKAEFAEVSK

LVTDLTKVHTECCHGDLLECADDRADLAKYICENQDSISSKLKECCE

KPLLEKSHCIAEVENDEMPADLPSLAADFVESKDVCKNYAEAKDVFL

GMFLYEYARRHPDYSVVLLLRLAKTYETTLEKCCAAADPHECYAKVF

DEFKPLVEEPQNLIKQNCELFEQLGEYKFQNALLVRYTKKVPQVSTP

TLVEVSRNLGKVGSKCCKHPEAKRMPCAEDYLSVVLNQLCVLHEKTP

VSDRVTKCCTESLVNRRPCFSALEVDETYVPKEFNAETFTFHADICT

LSEKERQIKKQTALVELVKHKPKATKEQLKAVMDDFAAFVEKCCKAD

DKETCFAEEGKKLVAASQAALGLGGGSGGGGSRPSGRKSSKMQAFR

IWDVNQKTFYLRNNQLVAGYLQGPNVNLEEKIDVVPIEPHALFLGIH

GGKMCLSCVKSGDETRLQLEAVNITDLSENRKQDKRFAFIRSDSGPT

TSFESAACPGWFLCTAMEADQPVSLTNMPDEGVMVTKFYFQEDE;

G-82:
(SEQ ID NO: 82)
HGEGTFTSDVSSYLEEQAAKEFIAWLVKGRPSSGAPPPSGGGSGGG

GSDAHKSEVAHRFKDLGEENFKALVLIAFAQYLQQCPFEDHVKLVNE

VTEFAKTCVADESAENCDKSLHTLFGDKLCTVATLRETYGEMADCCA

KQEPERNECFLQHKDDNPNLPRLVRPEVDVMCTAFHDNEETFLKKYL

YEIARRHPYFYAPELLFFAKRYKAAFTECCQAADKAACLLPKLDELR

DEGKASSAKQRLKCASLQKFGERAFKAWAVARLSQRFPKAEFAEVSK

LVTDLTKVHTECCHGDLLECADDRADLAKYICENQDSISSKLKECCE

KPLLEKSHCIAEVENDEMPADLPSLAADFVESKDVCKNYAEAKDVFL

GMFLYEYARRHPDYSVVLLLRLAKTYETTLEKCCAAADPHECYAKVE

DEFKPLVEEPQNLIKQNCELFEQLGEYKFQNALLVRYTKKVPQVSTP

TLVEVSRNLGKVGSKCCKHPEAKRMPCAEDYLSVVLNQLCVLHEKTP

VSDRVTKCCTESLVNRRPCFSALEVDETYVPKEFNAETFTFHADICT

LSEKERQIKKQTALVELVKHKPKATKEQLKAVMDDFAAFVEKCCKAD

DKETCFAEEGKKLVAASQAALGLGGGSGGGGSRPSGRKSSKMQAFR

IWDVNQKTFYLRNNQLVAGYLQGPNVNLEEKIDVVPIEPHALFLGIH

GGKMCLSCVKSGDETRLQLEAVNITDLSENRKQDKRFAFIRSDSGPT

TSFESAACPGWFLCTAMEADQPVSLTNMPDEGVMVTKFYFQEDE;

G-83:
(SEQ ID NO: 83)
HGEGTFTSDLSKQMEEEAVRLFIEWLKNGGPSSGAPPPSGGGSGGG

GSRPSGRKSSKMQAFRIWDVNQKTFYLRNNQLVAGYLQGPNVNLEEK

IDVVPIEPHALFLGIHGGKMCLSCVKSGDETRLQLEAVNITDLSENR

KQDKRFAFIRSDSGPTTSFESAACPGWFLCTAMEADQPVSLTNMPDE

-continued

GVMVTKEYFQEDEGGGGSGGGGSDAHKSEVAHREKDLGEENFKALVL

IAFAQYLQQCPFEDHVKLVNEVTEFAKTCVADESAENCDKSLHTLFG

DKLCTVATLRETYGEMADCCAKQEPERNECFLQHKDDNPNLPRLVRP

EVDVMCTAFHDNEETFLKKYLYEIARRHPYFYAPELLFFAKRYKAAF

TECCQAADKAACLLPKLDELRDEGKASSAKQRLKCASLQKFGERAFK

AWAVARLSQRFPKAEFAEVSKLVTDLTKVHTECCHGDLLECADDRAD

LAKYICENQDSISSKLKECCEKPLLEKSHCIAEVENDEMPADLPSLA

ADEVESKDVCKNYAEAKDVFLGMFLYEYARRHPDYSVVLLLRLAKTY

ETTLEKCCAAADPHECYAKVFDEFKPLVEEPQNLIKQNCELFEQLGE

YKFQNALLVRYTKKVPQVSTPTLVEVSRNLGKVGSKCCKHPEAKRMP

CAEDYLSVVLNQLCVLHEKTPVSDRVTKCCTESLVNRRPCFSALEVD

ETYVPKEFNAETFTFHADICTLSEKERQIKKQTALVELVKHKPKATK

EQLKAVMDDFAAFVEKCCKADDKETCFAEEGKKLVAASQAALGL;

G-84:
(SEQ ID NO: 84)
HGEGTFTSDVSSYLEEQAAKEFIAWLVKGRPSSGAPPPSGGGGSGGG

GSRPSGRKSSKMQAFRIWDVNQKTFYLRNNQLVAGYLQGPNVNLEEK

IDVVPIEPHALFLGIHGGKMCLSCVKSGDETRLQLEAVNITDLSENR

KQDKRFAFIRSDSGPTTSFESAACPGWELCTAMEADQPVSLTNMPDE

GVMVTKFYFQEDEGGGGSGGGGSDAHKSEVAHRFKDLGEENFKALVL

IAFAQYLQQCPFEDHVKLVNEVTEFAKTCVADESAENCDKSLHTLFG

DKLCTVATLRETYGEMADCCAKQEPERNECFLQHKDDNPNLPRLVRP

EVDVMCTAFHDNEETFLKKYLYEIARRHPYFYAPELLFFAKRYKAAF

TECCQAADKAACLLPKLDELRDEGKASSAKQRLKCASLQKFGERAFK

AWAVARLSQRFPKAEFAEVSKLVTDLTKVHTECCHGDLLECADDRAD

LAKYICENQDSISSKLKECCEKPLLEKSHCIAEVENDEMPADLPSLA

ADFVESKDVCKNYAEAKDVFLGMFLYEYARRHPDYSVVLLLRLAKTY

ETTLEKCCAAADPHECYAKVFDEFKPLVEEPQNLIKQNCELFEQLGE

YKFQNALLVRYTKKVPQVSTPTLVEVSRNLGKVGSKCCKHPEAKRMP

CAEDYLSVVLNQLCVLHEKTPVSDRVTKCCTESLVNRRPCFSALEVD

ETYVPKEFNAETFTFHADICTLSEKERQIKKQTALVELVKHKPKATK

EQLKAVMDDFAAFVEKCCKADDKETCFAEEGKKLVAASQAALGL;

In the sequences in the section, the structure of C (S-maleimide-$(CH_2)_n$—COOH) is shown as follows:

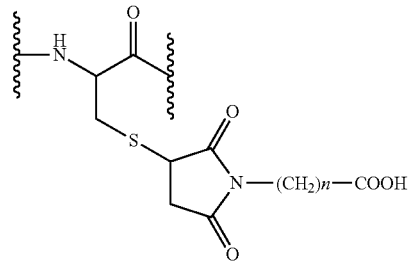

wherein n is an integer from 1 to 25.

In the sequences in the section, the structure of C[S—$CH_2$—CONH—$(CH_2CH_2O)_2$—$(CH_2)_2$—NH—($N^\alpha$—(HOOC$(CH_2)_{14}$CO)-γ-Glu)] is shown as follows:

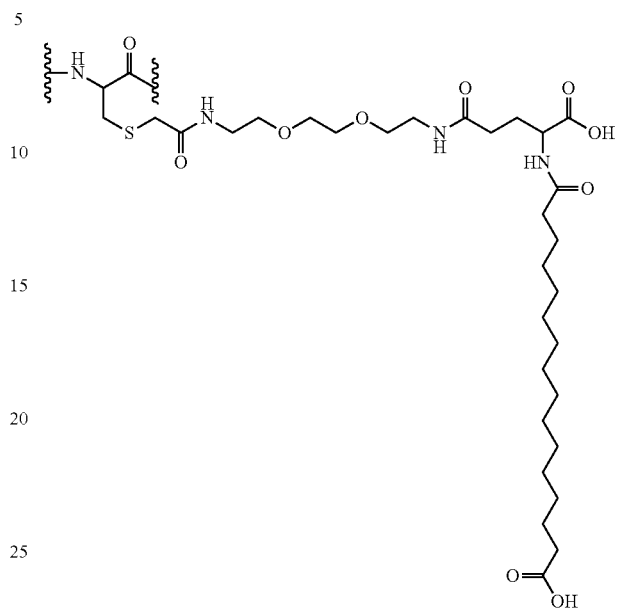

In the sequences in the section, the structure of C—[S—$CH_2$—CONH—$(CH_2CH_2O)_2$—$(CH_2)_2$—NH—($N^\alpha$—(HOOC$(CH_2)_4$CO)-γ-Glu] is shown as follows:

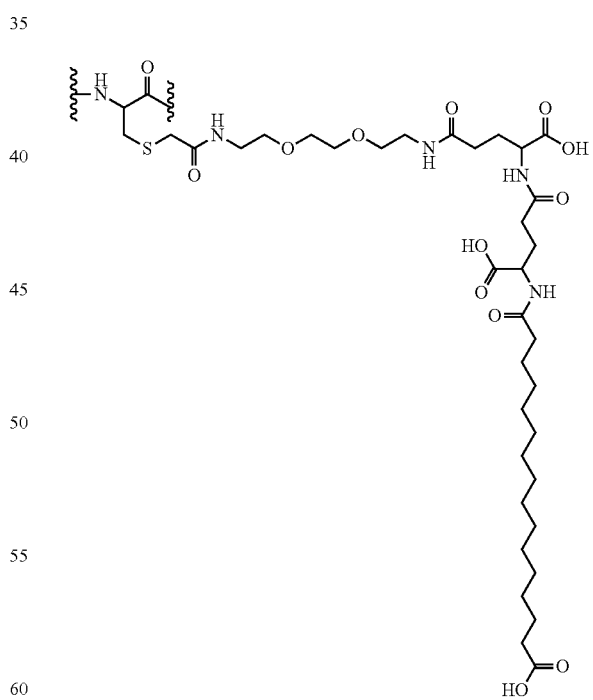

In the sequences in the section, the structure of C[S-maleimide-$(CH_2)_4$—NH—($N^\alpha$—(HOOC$(CH_2)_{14}$CO)-γ-Glu)] is shown as follows:

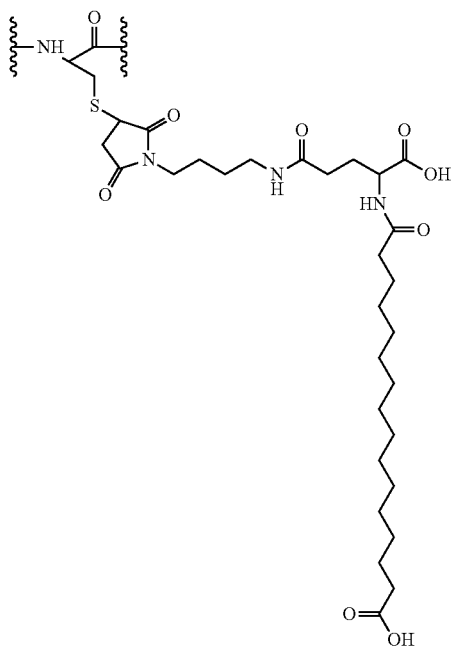 [SMILES: *NC(CSC1CC(=O)N(CCCCNC(=O)CCC(NC(=O)CCCCCCCCCCCCCCC(=O)O)C(=O)O)C1=O)C(*)=O]

In the sequences in the section, the structure of maleimide-PEG11-maleimide is shown as follows:

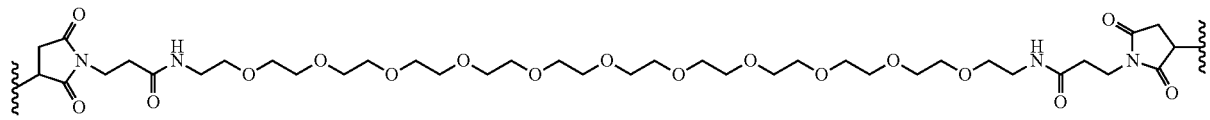 [SMILES: *C1CC(=O)N(CCC(=O)NCCOCCOCCOCCOCCOCCOCCOCCOCCOCCOCCOCCNC(=O)CCN2C(=O)CC(*)C2=O)C1=O]

In the sequences in the section, the structure of maleimide-PEG20K-maleimide is shown as follows:

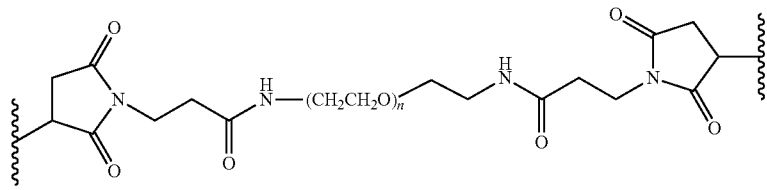

wherein n is an integer from 0 to 2000.

2. The fusion protein consisting of the insulin receptor binding polypeptide and the interleukin-1 receptor antagonistic protein The insulin receptor binding polypeptide comprises an A chain and a B chain, in which the amino acid sequence of the A chain is:

(SEQ ID NO: 380)
GIVEQC$_{[3]}$C$_{[4]}$X$_{IN8}$SIC$_{[5]}$SLYQLENYC$_{[6]}$X$_{IN21}$X$_{IN22}$
or (SEQ ID NO: 381)
GIVEQC$_{[3]}$C$_{[4]}$TSIC$_{[5]}$SLYQLENYC$_{[6]}$N;

The amino acid sequence of the B chain is:

(SEQ ID NO: 382)
X$_{IN23-26}$HLC$_{[1]}$GSHLVEALYLVC$_{[2]}$GERGFX$_{IN47}$X$_{IN48}$X$_{IN49}$

X$_{IN50}$X$_{IN51}$X$_{IN52}$, wherein

X$_{IN8}$ is a threonine, histidine, or arginine; X$_{IN21}$ is an alanine, glycine, or asparagine; X$_{IN22}$ is a lysine, a dipeptide of arginine-lysine, or absent; X$_{IN23-26}$ is a tetrapeptide of phenylalanine-valine-asparagine-glutamine, a tripeptide of valine-asparagine-glutamine, a dipeptide of asparagine-glutamine, glutamine, or absent; X$_{IN47}$ is a tyrosine, or phenylalanine; X$_{IN48}$ is a —NH$_2$, dA-NH$_2$, tyrosine, or phenylalanine; X$_{IN49}$ is a threonine, asparagine, or absent; X$_{IN50}$ is a lysine, proline, glutamic acid, aspartic acid, or absent; X$_{IN51}$ is a proline, arginine, lysine, glutamic acid, aspartic acid, or absent; X$_{IN52}$ is a threonine, threonine-arginine-arginine, or absent;

[1] to [6] in the compound indicate the Nos. of the cysteines; 3 pairs of disulfide bonds are formed with six cysteines in the compound, in which the A chain and the B chain are connected by two pairs of interchain disulfide bonds, a pair of intrachain disulfide bond is present in the A chain, and the specific positions for the three pairs of the disulfide bonds are: C$_{[1]}$ and C$_{[4]}$ forming a disulfide bond, C$_{[2]}$ and C$_{[6]}$ forming a disulfide bond, and C$_{[3]}$ and C$_{[5]}$ forming a disulfide bond.

In another embodiment, the structure of the amino acid sequence of the single chain insulin receptor binding polypeptide is:

(SEQ ID NO: 383)
X$_{IN107}$HLC$_{[1]}$GSX$_{IN108}$LVEALYLVC$_{[2]}$GEX$_{IN109}$GFX$_{IN110}$

X$_{IN111}$X$_{IN112}$X$_{IN113}$X$_{IN114}$X$_{IN115}$-C$_L$-GIVEQC$_{[3]}$C$_{[4]}$X$_{IN127}$

SIC$_{[5]}$SLYQLENYC$_{[6]}$X$_{IN128}$X$_{IN129}$,

X$_{IN107}$ is a tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the tetrapeptide, tripeptide, and dipeptide is substituted with a lysine or arginine, or absent; X$_{IN108}$ is a histidine, phenylalanine, arginine, or glutamine; X$_{IN109}$ is an arginine, alanine, glutamic acid, or aspartic acid; X$_{IN110}$ is a phenylalanine, tyrosine, or histidine; $X_{IN111}$ is a tyrosine, phenylalanine, or absent; $X_{IN112}$ is a threonine, asparagine, or absent; $X_{IN113}$ is a proline, lysine, glutamic acid, aspartic acid, or absent; $X_{IN114}$ is a lysine, proline, arginine, glutamic acid, aspartic acid or absent; $X_{IN115}$ is a threonine, or absent; $X_{IN127}$ is a threonine, histidine, or arginine; $X_{IN128}$ is an alanine, glycine, or asparagine; $X_{IN129}$ is a lysine, a dipeptide of arginine-lysine, or absent; $C_L$ is a peptide sequence of 6-60 amino acids, wherein the amino acids are primarily selected from the group consisting of glycine, alanine, serine, threonine and proline.

A suitable linking fragment $C_L$ has three characteristics. The first characteristic is that linking fragment is required to have an appropriate length. When the B chain has the full length of thirty amino acids, the linking fragment is better to have no less than six amino acids in length. When the B chain has twenty-five amino acids, the linking fragment is better to have no less than ten amino acids in length. If the length of the linking fragment is too long or too short (shorter than above-mentioned number of the amino acids, or longer than sixty amino acids), the binding capability of the single chain analogue of the insulin receptor tends to decrease. The second is that the linking fragment is preferred to have no secondary structure, so that its spatial conformation can be changed flexibly. The third is that the linking fragment itself has no biological activity and can provide the sites for polypeptide modification, such as, sites for acylation, glycosylation, etc.

The linking fragment $C_L$ may include one or more of aspartic acid, glutamic acid, arginine, lysine, cysteine or asparagine residues. $C_L$ may comprise 1, 2, 3, 4 of aspartic acid, glutamic acid, arginine, or lysine residues to regulate the charge equilibrium in the sequence of the polypeptide and improve solubility thereof. The sequence can comprise 1, 2, 3, 4, 5 of asparagine and the same amount of serine or threonine, thus constituting a consensus sequence N—X—S/T required for the N-glycosylation (X is an encodable natural amino acid). Furthermore, the peptide can further comprise 1, 2, 3 or 4 of lysine or cysteine residues, of which the amino or mercapto group on the side chain can be linked to a natural or synthetic modifying group such as a fatty acid, polyethylene glycol, an albumin, etc. through a hydrolysable or unhydrolysable bond, thus providing the modified insulin analogue with different physical, chemical, and biological properties.

In accordance with one embodiment, the C-terminal amino acid of the $C_L$ may be selected from the group consisting of glycine-lysine, glycine-arginine, arginine-arginine, lysine-lysine, arginine-lysine, lysine-arginine, proline-glutamine-threonine, proline-glutamine-lysine, or proline-glutamine-arginine. In accordance with one embodiment, the C-terminal amino acid of the $C_L$ is selected from a lysine or arginine.

In an embodiment, $C_L$ is $$GX_{IN116}X_{IN117}X_{IN118}X_{IN119}X_{IN120}X_{IN121}X_{IN122}X_{IN123}X_{IN124}X_{IN125}X_{IN126}, \quad \text{(SEQ ID NO: 384)}$$

wherein $X_{IN116}$ is a lysine, cysteine, serine, or alanine; $X_{IN117}$ is a glycine, lysine, or serine; $X_{IN118}$ is a lysine or serine; $X_{IN119}$ is a lysine or serine; $X_{IN120}$ is a lysine, serine, or alanine; $X_{IN121}$ is a glycine, lysine, arginine, alanine, proline, or absent; $X_{IN122}$ is a glycine, alanine, arginine, lysine, glutamine, proline, or absent; $X_{IN123}$ is an arginine, lysine, glycine, alanine, proline, threonine, glutamine, or absent; $X_{IN124}$ is a proline, glutamine, lysine, glycine, arginine, or absent; $X_{IN125}$ is a glutamine, threonine, lysine, glycine, arginine, or absent; $X_{IN126}$ is a threonine, arginine, lysine, or absent;

In a particular embodiment, $C_L$ $$GAGSSSAAAPQT, \quad \text{(SEQ ID NO: 385)}$$

$$GSGSSSAAAPQT, \quad \text{(SEQ ID NO: 386)}$$

$$GSGSSSAAPQT, \quad \text{(SEQ ID NO: 387)}$$

$$GSGSSSAPQT, \quad \text{(SEQ ID NO: 388)}$$

or $$GSGSSAPQT. \quad \text{(SEQ ID NO: 389)}$$

In another embodiment, the structure of the amino acid sequence of the single chain insulin receptor binding polypeptide is:

$$\text{FVNQHLC}_{[1]}\text{GSHLVEALYLVC}_{[2]}\text{GERGFFX}_{IN111}X_{IN112}X_{IN113}X_{IN114}$$
$$X_{IN115}\text{-}C_L\text{-GIVEQC}_{[3]}C_{[4]}\text{TSIC}_{[5]}\text{SLYQLENYC}_{[6]}\text{N}, \quad \text{(SEQ ID NO: 390)}$$

wherein each of the variables is defined as the above.

The present invention further provides a compound modified on the basis of the insulin receptor binding polypeptide for further increasing the in vivo circulation time for exerting the function of the compound. Said modification is one in which the modified side chain is linked to the α-amino group of the amino acid residue at the N-terminus of the B chain of the double-chain compound according to the present invention or at the N-terminus of the single chain compound according to the present invention, or to the ε-amino group of the lysine present in the double- or single chain compound of the present invention.

In one embodiment, the compound comprises an A chain and a B chain, wherein
the amino acid sequence of the A chain is:

$$\text{GIVEQC}_{[3]}C_{[4]}\text{TSIC}_{[5]}X_{IN412}\text{L}X_{IN414}X_{IN415}\text{L}X_{IN417}X_{IN418} \quad \text{(SEQ ID NO: 391)}$$
$$\text{YC}_{[6]}X_{IN421}X_{IN422},$$

the amino acid sequence of the B chain is:

$$X_{IN423\text{-}426}\text{HLC}_{[1]}\text{GSHLVEALYLVC}_{[2]}\text{GERGFX}_{IN447}X_{IN448}X_{IN449}X_{IN450} \quad \text{(SEQ ID NO: 392)}$$
$$X_{IN451}X_{IN452}X_{IN453},$$

[1] to [6] in the compound indicate the Nos of the cysteines; 3 pairs of disulfide bonds are formed with six cysteines in the compound, in which the A chain and the B chain are connected by two pairs of interchain disulfide bonds, a pair of intrachain disulfide bond is present in the A chain, and the specific positions for the three pairs of the disulfide bonds are: $C_{[1]}$ and $C_{[4]}$ forming a disulfide bond, $C_{[2]}$ and $C_{[6]}$ forming a disulfide bond, and $C_{[3]}$ and $C_{[5]}$ forming a disulfide bond;

in which $X_{IN412}$ is a serine or a structure of general formula 1; $X_{IN414}$ is a tyrosine or a structure of general formula 1; $X_{IN415}$ is a glutamine or a structure of general formula 1; $X_{IN417}$ is a glutamic acid or a structure of general formula 1; $X_{IN418}$ is an asparagine or a structure of general formula 1; $X_{IN421}$ is an asparagine, alanine, or glycine; $X_{IN422}$ is a lysine, general formula 3, arginine-general formula 3 or absent; $X_{IN423-426}$ is a glycine-proline-glutamic acid tripeptide, $U_L$-glycine-proline-glutamic acid, a tetrapeptide of phenylalanine-valine-asparagine-glutamine or $U_L$-phenylalanine-valine-asparagine-glutamine; $X_{IN447}$ is a tyrosine or phenylalanine; $X_{IN448}$ is a —NH$_2$, phenylalanine, tyrosine, or absent; $X_{IN449}$ is a threonine, asparagine, or absent; $X_{IN450}$ is a lysine, arginine, glutamic acid, aspartic acid, proline, or absent; $X_{IN451}$ is a proline, lysine, arginine, glutamic acid, aspartic acid, or absent, or is a structure of general formula 1 or 3; $X_{IN452}$ is a threonine, lysine, or absent, or is a structure of general formula 1 or 3; $X_{IN453}$ is a lysine or absent, or is a structure of general formula 3; $U_L$ is defined as herein.

In another embodiment, the structure of the amino acid sequence of the single-stranded compound is:

(SEQ ID NO: 393)
$U_L$-$X_{IN300}$HLC$_{[1]}$GSHLVEALYLVC$_{[2]}$GERGFX$_{IN301}$$X_{IN302}$$X_{IN303}$ $X_{IN304}$$X_{IN305}$$X_{IN306}$G$X_{IN307}$$X_{IN308}$$X_{IN309}$$X_{IN310}$$X_{IN311}$$X_{IN312}$$X_{IN313}$ $X_{IN314}$$X_{IN315}$$X_{IN316}$$X_{IN317}$GIVEQC$_{[3]}$C$_{[4]}$$X_{IN318}$SIC$_{[5]}$$X_{IN319}$

L$X_{IN320}$$X_{IN321}$L$X_{IN322}$$X_{IN323}$YC$_{[6]}$$X_{IN324}$$X_{IN325}$, in which $X_{IN300}$ is a tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the tetrapeptide, tripeptide, and dipeptide is substituted with a lysine or arginine, or absent; $X_{IN301}$ is a phenylalanine, histidine or tyrosine; $X_{IN302}$ is a —NH$_2$, tyrosine, phenylalanine, or absent; $X_{IN303}$ is a threonine, asparagine, or absent; $X_{IN304}$ is a proline, lysine, glutamic acid, aspartic acid, or absent; $X_{IN305}$ is an aspartic acid, glutamic acid, proline, arginine, lysine, absent or a structure of general formula 1; $X_{IN306}$ is a threonine, a structure of general formula 1, or absent; $X_{IN307}$ is a serine, alanine, glycine, lysine, a structure of general formula 1, or absent; $X_{IN308}$ is a glycine, a structure of general formula 1, or absent; $X_{IN309}$ is a lysine, glycine, serine, a structure of general formula 1, or absent; $X_{IN310}$ is a lysine, glycine, serine, a structure of general formula 1, or absent; $X_{IN311}$ is a lysine, glycine, serine, alanine, a structure of general formula 1, or absent; $X_{IN312}$ is a lysine, arginine, alanine, proline, glycine, a structure of general formula 1, or absent; $X_{IN313}$ is a glycine, alanine, arginine, lysine, proline, a structure of general formula 1, or absent; $X_{IN314}$ is an arginine, alanine, proline, threonine, glutamine, glycine, a structure of general formula 1, or absent; $X_{IN315}$ is a proline, glutamine, arginine, glycine, absent, or a structure of general formula 1; $X_{IN316}$ is a glutamine, threonine, arginine, glycine, absent, or a structure of general formula 1; $X_{IN317}$ is a threonine, arginine, lysine, or absent; $X_{IN318}$ is a threonine, histidine, arginine or a structure of general formula 1; $X_{IN319}$ is a serine or a structure of general formula 1; $X_{IN320}$ is a tyrosine or a structure of general formula 1; $X_{IN321}$ is a glutamine or a structure of general formula 1; $X_{IN322}$ is a glutamic acid or a structure of general formula 1; $X_{IN323}$ is an asparagine or a structure of general formula 1; $X_{IN324}$ is an aspartic acid, glycine, alanine, or a structure of general formula 1; $X_{IN325}$ is a lysine, general formula 3, arginine-general formula 3, or absent; $U_L$ and the structures of general formulas 1 and 3 are defined as herein.

In another embodiment, the compound has another single chain structure, the amino acid sequence of which is:

(SEQ ID NO: 394)
$U_L$-FVNQHLC$_{[1]}$GSHLVEALYLVC$_{[2]}$GERGFFX$_{IN302}$$X_{IN303}$ $X_{IN304}$$X_{IN305}$$X_{IN306}$G$X_{IN307}$$X_{IN308}$$X_{IN309}$$X_{IN310}$$X_{IN311}$$X_{IN312}$ $X_{IN313}$$X_{IN314}$$X_{IN315}$$X_{IN316}$$X_{IN317}$GIVEQC$_{[3]}$C$_{[4]}$TSIC$_{[5]}$SLY

QLENYC$_{[6]}$N$X_{IN325}$, wherein each of the variables is defined as herein.

The insulin receptor binding polypeptide and the interleukin-1 receptor antagonistic protein are able to protect pancreas islet β-cells by similar or distinct mechanisms, thereby treating diabetes mellitus. Accordingly, the fusion protein formed by joining the two polypeptides may attain a therapeutic effect more excellent than that with either of the polypeptides alone, due to the synergistic effect by the two polypeptides. Furthermore, one of the causes for the onset of diabetes is often the inflammation in and around the tissues where the insulin receptor is primarily distributed. The insulin receptor binding polypeptide can serve as a target for the fusion protein and enrich the interleukin-1 receptor antagonistic protein in the tissues, more effectively exerting actions such as anti-inflammation, etc.

The insulin receptor binding polypeptide is linked to the interleukin-1 receptor antagonistic protein in various linkages through an alternative linking group (or spacer group).

(1) The insulin receptor binding polypeptide is lined to the interleukin-1 receptor antagonistic protein in the following form (from left to right corresponding to the amino acid sequence from N-terminus to C-terminus):

the insulin receptor binding polypeptide—linking group (or spacer group)-interleukin-1 receptor antagonistic protein; or the interleukin-1 receptor antagonistic protein-linking group (or spacer group)—the insulin receptor binding polypeptide;

In one embodiment, the sequence of the fusion protein is (SEQ ID NO: 395)
$U_L$-$X_{IN107}$HLC$_{[1]}$GS$X_{IN108}$LVEALYLVC$_{[2]}$GE$X_{IN109}$GF$X_{IN110}$$X_{IN111}$ $X_{IN112}$$X_{IN113}$$X_{IN114}$$X_{IN115}$-$C_L$-GIVEQC$_{[3]}$C$_{[4]}$$X_{IN127}$SIC$_{[5]}$SLYQL ENYC$_{[6]}$$X_{IN128}$$X_{IN129}$-L$_j$-$X_{IL0}$RPSGRKSSKMQAFRIWDVNQKTFYL

RNNQLVAGYLQGPNVNLEEKIDVVPIEPHALFLGIHGGKM$X_{IL66}$

LS$X_{IL69}$VKSGDETRLQLEAV$X_{IL84}$ITDLSENRKQDKRFAFIRSDSGP

TTSFESAA$X_{IL116}$PGWFL$X_{IL122}$TAMEADQPVSLTNMPDEGVMVTKFY

FQEDE, or (SEQ ID NO: 396)
$U_L$-$X_{IN107}$HLC$_{[1]}$GSHLVEALYLVC$_{[2]}$GERGFX$_{IN110}$$X_{IN111}$$X_{IN112}$$X_{IN113}$ $X_{IN114}$$X_{IN115}$-$C_L$-GIVEQC$_{[3]}$C$_{[4]}$TSIC$_{[5]}$SLYQLENYC$_{[6]}$N-

(GGGGS)$_m$-$X_L$-(GGGGS)$_n$-$X_{IL0}$RPSGRKSSKMQAFRIWDVNQKTFYL

RNNQLVAGYLQGPNVNLEEKIDVVPIEPHALFLGIHGGKM$X_{IL66}$LS$X_{IL69}$

VKSGDETRLQLEAVX$_{IL84}$ITDLSENRKQDKRFAFIRSDSGPTTSFESAAX$_{IL116}$PGWFLX$_{IL122}$TAMEADQPVSLTNMPDEGVMVTKFYFQEDE,
or (SEQ ID NO: 397)
U$_L$-FVNQHLC$_{[1]}$GSHLVEALYLVC$_{[2]}$GERGFFYTPKT-C$_L$-GIVEQC$_{[3]}$C$_{[4]}$TSIC$_{[5]}$SLYQLENYC$_{[6]}$N-(GGGGS)$_m$-X$_L$-(GGGGS)$_n$-X$_{IL0}$RPSGRKSSKNIQAFRIWDVNQKTFYLRNNQLVAGYLQGPNVNLEEKIDVVPIEPHALFLGIHGGKMX$_{IL66}$LSX$_{IL69}$VKSGDETRLQLEAVNITDLSENRKQDKRFAFIRSDSGPTTSFESAAX$_{IL116}$PGWFLX$_{IL122}$TAMEADQPVSLTNMPDEGVMVTKFYFQEDE,
or (SEQ ID NO: 398)
U$_L$-FVNQHLC$_{[1]}$GSHLVEALYLVC$_{[2]}$GERGFFYTPKT-C$_L$-GIVEQC$_{[3]}$C$_{[4]}$TSIC$_{[5]}$SLYQLENYC$_{[6]}$N-(GGGGS)$_n$-X$_{IL0}$RPSGRKSSKNIQAFRIWDVNQKTFYLRNNQLVAGYLQGPNVNLEEKIDVVPIEPHALFLGIHGGKNIX$_{IL66}$LSX$_{IL69}$VKSGDETRLQLEAVNITDLSENRKQDKRFAFIRSDSGPTTSFESAAX$_{IL116}$PGWFLX$_{IL122}$TAMEADQPVSLTNMPDEGVMVTKFYFQEDE;
or (SEQ ID NO: 399)
U$_L$-X$_{IL0}$RPSGRKSSKMQAFRIWDVNQKTFYLRNNQLVAGYLQGPNVNLEEKIDVVPIEPHALFLGIHGGKMX$_{IL66}$LSX$_{IL69}$VKSGDETRLQLEAVX$_{IL84}$ITDLSENRKQDKRFAFIRSDSGPTTSFESAAX$_{IL116}$PGWFLX$_{IL122}$TAMEADQPVSLTNMPDEGVMVTKFYFQEDE-L$_j$-X$_{IN107}$HLC$_{[1]}$GSX$_{IN108}$LVEALYLVC$_{[2]}$GEX$_{IN109}$GFX$_{IN110}$X$_{IN111}$X$_{IN112}$X$_{IN113}$X$_{IN114}$X$_{IN115}$-C$_L$-GIVEQC$_{[3]}$C$_{[4]}$X$_{IN127}$SIC$_{[5]}$SLYQLENYC$_{[6]}$X$_{IN128}$X$_{IN129}$;
or (SEQ ID NO: 400)
U$_L$-X$_{IL0}$RPSGRKSSKMQAFRIWDVNQKTFYLRNNQLVAGYLQGPNVNLEEKIDVVPIEPHALFLGIHGGKMX$_{IL66}$LSX$_{IL69}$VKSGDETRLQLEAVX$_{IL84}$ITDLSENRKQDKRFAFIRSDSGPTTSFESAAX$_{IL116}$PGWFLX$_{IL122}$TAMEADQPVSLTNMPDEGVMVTKFYFQEDE-(GGGGS)$_m$-X$_L$-(GGGGS)$_n$-X$_{IN107}$HLC$_{[1]}$GSHLVEALYLVC$_{[2]}$GERGFX$_{IN110}$X$_{IN111}$X$_{IN112}$X$_{IN113}$X$_{IN114}$X$_{IN115}$-C$_L$-GIVEQC$_{[3]}$C$_{[4]}$TSIC$_{[5]}$SLYQLENYC$_{[6]}$X$_{IN128}$X$_{IN129}$,
or (SEQ ID NO: 401)
U$_L$-X$_{IL0}$RPSGRKSSKMQAFRIWDVNQKTFYLRNNQLVAGYLQGPNVNLEEKIDVVPIEPHALFLGIHGGKMX$_{IL66}$LSX$_{IL69}$VKSGDETRLQLEAVNITDLSENRKQDKRFAFIRSDSGPTTSFESAAX$_{IL116}$PGWFLX$_{IL122}$TAMEADQPVSLTNMPDEGVMVTKFYFQEDE-(GGGGS)$_m$-X$_L$-(GGGGS)$_n$-FVNQHLC$_{[1]}$GSHLVEALYLVC$_{[2]}$GERGFFYTPKT-C$_L$-GIVEQC$_{[3]}$C$_{[4]}$TSIC$_{[5]}$SLYQLENYC$_{[6]}$N;
or (SEQ ID NO: 402)
U$_L$-X$_{IL0}$RPSGRKSSKMQAFRIWDVNQKTFYLRNNQLVAGYLQGPNVNLEEKIDVVPIEPHALFLGIHGGKMX$_{IL66}$LSX$_{IL69}$VKSGDETRLQLEAVNITDLSENRKQDKRFAFIRSDSGPTTSFESAAX$_{IL116}$PGWFLX$_{IL122}$TAMEADQPVSLTNMPDEGVMVTKFYFQEDE-(GGGGS)$_n$-FVNQHLC$_{[1]}$GSHLVEALYLVC$_{[2]}$GERGFFYTPKT-C$_L$-GIVEQC$_{[3]}$C$_{[4]}$TSIC$_{[5]}$SLYQLENYC$_{[6]}$N;
or (SEQ ID NO: 403)
U$_L$-X$_{IL0}$RPSGRKSSKMQAFRIWDVNQKTFYLRNNQLVAGYLQGPNVNLEEKIDVVPIEPHALFLGIHGGKMX$_{IL66}$LSX$_{IL69}$VKSGDETRLQLEAVX$_{IL84}$ITDLSENRKQDKRFAFIRSDSGPTTSFESAAX$_{IL116}$PGWFLX$_{IL122}$TAMEADQPVSLTNMPDEGVMVTKFYFQEDE-(GGGGS)$_m$-X$_L$-(GGGGS)$_n$-FVNQHLCGSHLVEALYLVCGERGFFYTPKTGSGSSSAAAPQTGIVEQCCTSICSLYQLENYCN;

in the above-mentioned sequences, m and n are each 0, 1, 2, 3, 4, 5, or 6 and other variables are defined as herein;

[1] to [6] indicate the Nos. of the cysteines; 3 pairs of disulfide bonds are formed by six cysteines in the compound, in which the A chain and the B chain are connected by two pairs of interchain disulfide bonds, a pair of intrachain disulfide bond is present in the A chain, and the specific positions for the three pairs of the disulfide bonds are: $C_{[1]}$ and $C_{[4]}$ forming a disulfide bond, $C_{[2]}$ and $C_{[6]}$ forming a disulfide bond, and $C_{[3]}$ and $C_{[5]}$ forming a disulfide bond.

The fusion protein consisting of the insulin receptor binding polypeptide and the interleukin-1 receptor antagonist -continued IN-3:
(SEQ ID NO: 87)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE;

IN-4:
(SEQ ID NO: 88)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE;

IN-5:
(SEQ ID NO: 89)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE;

IN-6:
(SEQ ID NO: 90)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE;

IN-7:
(SEQ ID NO: 91)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE;

IN-8:
(SEQ ID NO: 92)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE;

IN-9:
(SEQ ID NO: 93)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSGGGGSRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE;

IN-10:
(SEQ ID NO: 94)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSE

NRKQDKRFAFIRSDSGPTTSFESAACPGWFLCTAMEADQPVSLTNMPDEGVMVTKFYFQ
EDE;

IN-11:
(SEQ ID NO: 95)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSGGGGSGGGGSRPSGRKSSKMQAFRIWDVNQKTFYLRNNQL
VAGYLQGPNVNLEEKIDVVPIEPHALFLGIHGGKMCLSCVKSGDETRLQLEAVNITDLSE
NRKQDKRFAFIRSDSGPTTSFESAASPGWFLCTAMEADQPVSLTNMPDEGVMVTKFYFQ
EDE;

IN-12:
(SEQ ID NO: 96)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSGGGGSGGGGSRPSGRKSSKMQAFRIWDVNQKTFYLRNNQL
VAGYLQGPNVNLEEKIDVVPIEPHALFLGIHGGKMSLSSVKSGDETRLQLEAVNITDLSE
NRKQDKRFAFIRSDSGPTTSFESAASPGWFLSTAMEADQPVSLTNMPDEGVMVTKFYFQ
EDE;

IN-13:
(SEQ ID NO: 97)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY
QLENYC$_{[6]}$NRPSGRKSSKMQAFRIWDVNQKTFYLRNNQLVAGYLQGPNVNLEEKIDVVP
IEPHALFLGIHGGKMCLSCVKSGDETRLQLEAVNITDLSENRKQDKRFAFIRSDSGPTTSF
ESAACPGWFLCTAMEADQPVSLTNMPDEGVMVTKFYFQEDE;

IN-14:
(SEQ ID NO: 98)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY
QLENYC$_{[6]}$NRPSGRKSSKMQAFRIWDVNQKTFYLRNNQLVAGYLQGPNVNLEEKIDVVP
IEPHALFLGIHGGKMCLSCVKSGDETRLQLEAVNITDLSENRKQDKRFAFIRSDSGPTTSF
ESAASPGWELCTAMEADQPVSLTNMPDEGVMVTKEYEQEDE;

IN-15:
(SEQ ID NO: 99)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY
QLENYC$_{[6]}$NRPSGRKSSKMQAFRIWDVNQKTFYLRNNQLVAGYLQGPNVNLEEKIDVVP
IEPHALFLGIHGGKMSLSSVKSGDETRLQLEAVNITDLSENRKQDKRFAFIRSDSGPTTSFE
SAASPGWFLSTAMEADQPVSLTNMPDEGVMVTKFYFQEDE;

IN-16:
(SEQ ID NO: 100)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY
QLENYC$_{[6]}$NGGGGSRPSGRKSSKMQAFRIWDVNQKTFYLRNNQLVAGYLQGPNVNLEE
KIDVVPIEPHALFLGIHGGKMCLSCVKSGDETRLQLEAVNITDLSENRKQDKRFAFIRSDS
GPTTSFESAACPGWFLCTAMEADQPVSLTNMPDEGVMVTKFYFQEDE;

IN-17:
(SEQ ID NO: 101)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY
QLENYC$_{[6]}$NGGGGSRPSGRKSSKMQAFRIWDVNQKTFYLRNNQLVAGYLQGPNVNLEE
KIDVVPIEPHALFLGIHGGKMCLSCVKSGDETRLQLEAVNITDLSENRKQDKRFAFIRSDS
GPTTSFESAASPGWFLCTAMEADQPVSLTNMPDEGVMVTKFYFQEDE;

-continued

IN-18:

(SEQ ID NO: 102)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY

QLENYC$_{[6]}$NGGGGSRPSGRKSSKMQAFRIWDVNQKTFYLRNNQLVAGYLQGPNVNLEE

KIDVVPIEPHALELGIHGGKMSLSSVKSGDETRLQLEAVNITDLSENRKQDKREAFIRSDS

GPTTSFESAASPGWFLSTAMEADQPVSLTNMPDEGVMVTKFYFQEDE;

IN-19:

(SEQ ID NO: 103)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY

QLENYC$_{[6]}$NGGGGSGGGGSRPSGRKSSKMQAFRIWDVNQKTFYLRNNQLVAGYLQGPN

VNLEEKIDVVPIEPHALFLGIHGGKMCLSCVKSGDETRLQLEAVNITDLSENRKQDKRFA

FIRSDSGPTTSFESAACPGWFLCTAMEADQPVSLTNMPDEGVMVTKFYFQEDE;

IN-20:

(SEQ ID NO: 104)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY

QLENYC$_{[6]}$NGGGGSGGGGSRPSGRKSSKMQAFRIWDVNQKTFYLRNNQLVAGYLQGPN

VNLEEKIDVVPIEPHALFLGIHGGKMCLSCVKSGDETRLQLEAVNITDLSENRKQDKRFA

FIRSDSGPTTSFESAASPGWFLCTAMEADQPVSLTNMPDEGVMVTKFYFQEDE;

IN-21:

(SEQ ID NO: 105)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY

QLENYC$_{[6]}$NGGGGSGGGGSRPSGRKSSKMQAFRIWDVNQKTFYLRNNQLVAGYLQGPN

VNLEEKIDVVPIEPHALELGIHGGKMSLSSVKSGDETRLQLEAVNITDLSENRKQDKREAF

IRSDSGPTTSFESAASPGWELSTAMEADQPVSLTNMPDEGVMVTKEYEQEDE;

IN-22:

(SEQ ID NO: 106)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY

QLENYC$_{[6]}$NGGGGSGGGGSGGGGSRPSGRKSSKMQAFRIWDVNQKTFYLRNNQLVAGY

LQGPNVNLEEKIDVVPIEPHALELGIHGGKMCLSCVKSGDETRLQLEAVNITDLSENRKQ

DKRFAFIRSDSGPTTSFESAACPGWFLCTAMEADQPVSLTNMPDEGVMVTKFYFQEDE;

IN-23:

(SEQ ID NO: 107)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY

QLENYC$_{[6]}$NGGGGSGGGGSGGGGSRPSGRKSSKMQAFRIWDVNQKTFYLRNNQLVAGY

LQGPNVNLEEKIDVVPIEPHALELGIHGGKMCLSCVKSGDETRLQLEAVNITDLSENRKQ

DKRFAFIRSDSGPTTSFESAASPGWFLCTAMEADQPVSLTNMPDEGVMVTKFYFQEDE;

IN-24:

(SEQ ID NO: 108)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLY

QLENYC$_{[6]}$NGGGGSGGGGSGGGGSRPSGRKSSKMQAFRIWDVNQKTFYLRNNQLVAGY

LQGPNVNLEEKIDVVPIEPHALELGIHGGKMSLSSVKSGDETRLQLEAVNITDLSENRKQ

DKRFAFIRSDSGPTTSFESAASPGWFLSTAMEADQPVSLTNMPDEGVMVTKFYFQEDE;

IN-25:

(SEQ ID NO: 109)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SL

YQLENYC$_{[6]}$NGGGGSGGGGSRPSGRKSSKMQAFRIWDVNQKTFYLRNNQLVAGYLQGP

NVNLEEKIDVVPIEPHALELGIHGGKMCLSCVKSGDETRLQLEAVNITDLSENRKQDKRE

AFIRSDSGPTTSPESAAC[$\underline{S}$-maleimide-(CH$_2$)$_4$-NH-(N$^\alpha$-(HOOC(CH$_2$)$_{14}$CO)-γ-Glu)]

-continued

PGWFLCTAMEADQPVSLTNMPDEGVMVTKFYFQEDE (<u>S</u> is the sulphur atom on the side chain of a cysteine residue);

IN-26:

(SEQ ID NO: 110)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SL
YQLENYC$_{[6]}$NGGGGSGGGGSRPSGRKSSKMQAFRIWDVNQKTFYLRNNQLVAGYLQGP
NVNLEEKIDVVPIEPHALFLGIHGGKMCLSCVKSGDETRLQLEAVC[<u>S</u>-CH$_2$-CONH-(CH$_2$C
H$_2$O)$_2$-(CH$_2$)$_2$-NH-(N$^\alpha$-(HOOC(CH$_2$)$_{14}$CO)-γ-Glu)]ITDLSENRKQDKRFAFIRSDS
GPTTSFESAASPGWFLCTAMEADQPVSLTNMPDEGVMVTKFYFQEDE (<u>S</u> is the sulphur atom on the side chain of a cysteine residue);

IN-27:

(SEQ ID NO: 111)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLYQLEN
YC$_{[6]}$NGGGGSGGGGSRPSGRKSSKMQAFRIWDVNQKTFYLRNNQLVAGYLQGPNVNLE
EKIDVVPIEPHALFLGIHGGKMCLSCVKSGDETRLQLEAVNITDLSENRKQDKRFAFIRSD
SGPTTSFESAAC(<u>S</u>-CH$_2$-CONH-PEG20K)PGWFLCTAMEADQPVSLTNMPDEGVMVTKE
YFQEDE (<u>S</u> is the sulphur atom on the side chain of a cysteine residue);

IN-28:

(SEQ ID NO: 112)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLYQLEN
YC$_{[6]}$NGGGGSGGGGSRPSGRKSSKMQAFRIWDVNQKTFYLRNNQLVAGYLQGPNVNLE
EKIDVVPIEPHALFLGIHGGKMCLSCVKSGDETRLQLEAVC(<u>S</u>-maleimide-(CH$_2$)$_{15}$-
COOH)ITDLSENRKQDKRFAFIRSDSGPTTSFESAASPGWELCTAMEADQPVSLTNMPDE
GVMVTKFYFQEDE (<u>S</u> is the sulphur atom on the side chain of a cysteine residue);

IN-62

(SEQ ID NO: 146)
RPSGRKSSKMQAFRIWDVNQKTFYLRNNQLVAGYLQGPNVNLEEKIDVVPIEPHAL
FLGIHGGKMCLSCVKSGDETRLQLEAVNITDLSENRKQDKRFAFIRSDSGPTTSELSAACP
GWELCTAMEADQPVSLTNMPDEGVMVTKEYFQEDEGGGGSGGGGSFVNQHLC$_{[1]}$GSHL
VEALYLVC$_{[2]}$GERGFFYTPKTGSGSSSAAAPQTGIVEQC$_{[3]}$C$_{[4]}$TSIC$_{[5]}$SLYQLENYC$_{[6]}$N;

IN-63

(SEQ ID NO: 147)
RPSGRKSSKMQAFRIWDVNQKTFYLRNNQLVAGYLQGPNVNLEEKIDVVPIEPHAL
FLGIHGGKMCLSCVKSGDETRLQLEAVNITDLSENRKQDKRFAFIRSDSGPTTSPESAASP
GWELCTAMEADQPVSLTNMPDEGVMVTKEYFQEDEGGGGSGGGGSFVNQHLC$_{[1]}$GSHL
VEALYLVC$_{[2]}$GERGFFYTPKTGSGSSSAAAPQTGIVEQC$_{[3]}$C$_{[4]}$TSIC$_{[5]}$SLYQLENYC$_{[6]}$N;

IN-64:

(SEQ ID NO: 148)
RPSGRKSSKMQAFRIWDVNQKTFYLRNNQLVAGYLQGPNVNLEEKIDVVPIEPHAL
FLGIHGGKMSLSSVKSGDETRLQLEAVNITDLSENRKQDKRFAFIRSDSGPTTSFESAASP
GWFLSTAMEADQPVSLTNMPDEGVMVTKEYFQEDEGGGGSGGGGSFVNQHLC$_{[1]}$GSHL
VEALYLVC$_{[2]}$GERGFFYTPKTGSGSSSAAAPQTGIVEQC$_{[3]}$C$_{[4]}$TSIC$_{[5]}$SLYQLENYC$_{[6]}$N;

IN-65

(SEQ ID NO: 149)
RPSGRKSSKMQAFRIWDVNQKTFYLRNNQLVAGYLQGPNVNLEEKIDVVPIEPHAL
FLGIHGGKMCLSCVKSGDETRLQLEAVCITDLSENRKQDKRFAFIRSDSGPTTSFESAASP

```
GWFLCTAMEADQPVSLTNMPDEGVMVTKEYFQEDEGGGGSGGGGSFVNQHLC[1]GSHL

VEALYLVC[2]GERGFFYTPKTGSGSSSAAAPQTGIVEQC[3]C[4]TSIC[5]SLYQLENYC[6]N;

IN-66
                                                    (SEQ ID NO: 150)
MRPSGRKSSKMQAFRIWDVNQKTFYLRNNQLVAGYLQGPNVNLEEKIDVVPIEPH

ALFLGIHGGKMCLSCVKSGDETRLQLEAVNITDLSENRKQDKRFAFIRSDSGPTTSFESAA

SPGWFLCTAMEADQPVSLTNMPDEGVMVTKFYFQEDEGGGGSCGGGGSGGGGSFVNQ

HLC[1]GSHLVEALYLVC[2]GERGFFYTPKTGSGSSSAAAPQTGIVEQC[3]C[4]TSIC[5]SLYQLE

NYC[6]N;

IN-67
                                                    (SEQ ID NO: 151)
FVNQHLC[1]GSHLVEALYLVC[2]GERGFFYTPKTGSGSSSAAAPQTGIVEQC[3]C[4]TSIC

[5]SLYQLENYC[6]NGGGGSGGGGSCGGGGSRPSGRKSSKMQAFRIWDVNQKTFYLRNNQ

LVAGYLQGPNVNLEEKIDVVPIEPHALFLGIHGGKMCLSCVKSGDETRLQLEAVNITDLS

ENRKQDKRFAFIRSDSGPTTSFESAASPGWFLCTAMEADQPVSLTNMPDEGVMVTKFYF

QEDE;
```

In the sequences of this section, [1] to [6] indicate the Nos. of the cysteines; 3 pairs of disulfide bonds are formed by six cysteines in the compound, in which the A chain and the B chain are connected by two pairs of interchain disulfide bonds, a pair of intrachain disulfide bond is present in the A chain, and the specific positions for the three pairs of the disulfide bonds are: $C_{[1]}$ and $C_{[4]}$ forming a disulfide bond, $C_{[2]}$ and $C_{[6]}$ forming a disulfide bond, and $C_{[3]}$ and $C_{[5]}$ forming a disulfide bond.

In one embodiment, the insulin receptor binding polypeptide, the interleukin-1 receptor antagonistic protein, and a biomacromolecule form a single chain compound, for which the structure is (from left to right corresponding to the amino acid sequence from N-terminus to C-terminus):

the insulin receptor binding polypeptide—linking group (or spacer group)-biomacromolecule-linking group (or spacer group)-interleukin-1 receptor antagonistic protein;

the insulin receptor binding polypeptide—linking group (or spacer group)-interleukin-1 receptor antagonistic protein-linking group (or spacer group)—the biomacromolecule;

the biomacromolecule-linking group (or spacer group)—the insulin receptor binding polypeptide—linking group (or spacer group)-interleukin-1 receptor antagonistic protein;

the biomacromolecule-linking group (or spacer group)—the interleukin-1 receptor antagonistic protein-linking group (or spacer group)—the insulin receptor binding polypeptide;

the interleukin-1 receptor antagonistic protein-linking group (or spacer group)-biomacromolecule-linking group (or spacer group)—the insulin receptor binding polypeptide; or the interleukin-1 receptor antagonistic protein-linking group (or spacer group)—the insulin receptor binding polypeptide—linking group (or spacer group)—the biomacromolecule;

in which the biomacromolecule may be albumin, IgG Fc, etc.

In one embodiment, the sequence of the fusion protein comprising the human albumin is:

(SEQ ID NO: 404)

DAHKSEVAHRFKDLGEENFKALVLIAFAQYLQQCPFEDHVKLVNEVTEFAKTCVAD

ESAENCDKSLHTLFGDKLCTVATLRETYGEMADCCAKQEPERNECFLQHKDDNPNLPRL

VRPEVDVMCTAFHDNEETFLKKYLYEIARRHPYFYAPELLFFAKRYKAAFTECCQAADK

AACLLPKLDELRDEGKASSAKQRLKCASLQKFGERAFKAWAVARLSQRFPKAEFAEVSK

LVTDLTKVHTECCHGDLLECADDRADLAKYICENQDSISSKLKECCEKPLLEKSHCIAEV

ENDEMPADLPSLAADFVESKDVCKNYAEAKDVFLGMFLYEYARRHPDYSVVLLLRLAK

TYETTLEKCCAAADPHECYAKVFDEFKPLVEEPQNLIKQNCELFEQLGEYKFQNALLVR

YTKKVPQVSTPTLVEVSRNLGKVGSKCCKHPEAKRMPCAEDYLSVVLNQLCVLHEKTP

VSDRVTKCCTESLVNRRPCFSALEVDETYVPKEFNAETFTFHADICTLSEKERQIKKQTAL

VELVKHKPKATKEQLKAVMDDFAAFVEKCCKADDKETCFAEEGKKLVAASQAALGL-(G

GGGS)$_m$-FVNQHLC$_{[1]}$GSHLVEALYLVC$_{[2]}$GERGFFYTPKT-C$_L$-GIVEQC$_{[3]}$C$_{[4]}$TSIC$_{[5]}$

-continued

```
SLYQLENYC[6]N-(GGGGS)n-RPSGRKSSKMQAFRIWDVNQKTFYLRNNQLVAGYLQGPNVN

LEEKIDVVPIEPHALFLGIHGGKMX(IL66)LSX(IL69)VKSGDETRLQLEAVNITDLSENRKQDKRFA

FIRSDSGPTTSFESAAX(IL116)PGWFLX(IL122)TAMEADQPVSLTNMPDEGVMVTKEYFQEDE;
or
                                                             (SEQ ID NO: 499)
DAHKSEVAHRFKDLGEENFKALVLIAFAQYLQQCPFEDHVKLVNEVTEFAKTCVAD

ESAENCDKSLHTLFGDKLCTVATLRETYGEMADCCAKQEPERNECFLQHKDDNPNLPRL

VRPEVDVMCTAFHDNEETFLKKYLYEIARRHPYFYAPELLFFAKRYKAAFTECCQAADK

AACLLPKLDELRDEGKASSAKQRLKCASLQKFGERAFKAWAVARLSQRFPKAEFAEVSK

LVTDLTKVHTECCHGDLLECADDRADLAKYICENQDSISSKLKECCEKPLLEKSHCIAEV

ENDEMPADLPSLAADFVESKDVCKNYAEAKDVFLGMFLYEYARRHPDYSVVLLLRLAK

TYETTLEKCCAAADPHECYAKVFDEFKPLVEEPQNLIKQNCELFEQLGEYKFQNALLVR

YTKKVPQVSTPTLVEVSRNLGKVGSKCCKHPEAKRMPCAEDYLSVVLNQLCVLHEKTP

VSDRVTKCCTESLVNRRPCFSALEVDETYVPKEFNAETFTFHADICTLSEKERQIKKQTAL

VELVKHKPKATKEQLKAVMDDFAAFVEKCCKADDKETCFAEEGKKLVAASQAALGL-(G

GGGS)m-RPSGRKSSKMQAFRIWDVNQKTFYLRNNQLVAGYLQGPNVNLEEKIDVVPIEP

HALFLGIHGGKMX(IL66)LSX(IL69)VKSGDETRLQLEAVNITDLSENRKQDKRFAFIRSDSGPTT

SFESAAX(IL116)PGWFLX(IL122)TAMEADQPVSLTNMPDEGVMVTKFYFQEDE-(GGGGS)n-FV

NQHLC[1]GSHLVEALYLVC[2]GERGFFYTPKT-C(L)-GIVEQC[3]C[4]TSIC[5]SLYQLENYC[6]N;
or
                                                             (SEQ ID NO: 405)
FVNQHL[1]GSHLVEALYLVC[2]GERGFFYTPKT-C(L)-GIVEQC[3]C[4]TSIC[5]SLYQLENY

C[6]N-(GGGGS)m-DAHKSEVAHRFKDLGEENFKALVLIAFAQYLQQCPFEDHVKLVNEVTE

FAKTCVADESAENCDKSLHTLFGDKLCTVATLRETYGEMADCCAKQEPERNECFLQHK

DDNPNLPRLVRPEVDVMCTAFHDNEETFLKKYLYEIARRHPYFYAPELLFFAKRYKAAFT

ECCQAADKAACLLPKLDELRDEGKASSAKQRLKCASLQKFGERAFKAWAVARLSQRFP

KAEFAEVSKLVTDLTKVHTECCHGDLLECADDRADLAKYICENQDSISSKLKECCEKPLL

EKSHCIAEVENDEMPADLPSLAADFVESKDVCKNYAEAKDVFLGMFLYEYARRHPDYS

VVLLLRLAKTYETTLEKCCAAADPHECYAKVFDEFKPLVEEPQNLIKQNCELFEQLGEY

KFQNALLVRYTKKVPQVSTPTLVEVSRNLGKVGSKCCKHPEAKRMPCAEDYLSVVLNQ

LCVLHEKTPVSDRVTKCCTESLVNRRPCFSALEVDETYVPKEFNAETFTFHADICTLSEK

ERQIKKQTALVELVKHKPKATKEQLKAVMDDFAAFVEKCCKADDKETCFAEEGKKLVA

ASQAALGL-(GGGGS)n-RPSGRKSSKMQAFRIWDVNQKTFYLRNNQLVAGYLQGPNVNL

EEKIDVVPIEPHALFLGIHGGKMX(IL66)LSX(IL69)VKSGDETRLQLEAVNITDLSENRKQDKRF

AFIRSDSGPTTSPESAAX(IL116)PGWFLX(IL122)TAMEADQPVSLTNMPDEGVMVTKFYFQEDE;
or
                                                             (SEQ ID NO: 406)
FVNQHLC[1]GSHLVEALYLVC[2]GERGFFYTPKT-C(L)-GIVEQC[3]C[4]TSIC[5]SLYQLENY

C[6]N-(GGGGS)m-RPSGRKSSKMQAFRIWDVNQKTFYLRNNQLVAGYLQGPNVNLEEKID

VVPIEPHALFLGIHGGKMX(IL66)LSX(IL69)VKSGDETRLQLEAVNITDLSENRKQDKRFAFIRS

DSGPTTSFESAAX(IL116)PGWFLX(IL122)TAMEADQPVSLTNMPDEGVMVTKFYFQEDE-(GGG

GS)n-DAHKSEVAHRFKDLGEENFKALVLIAFAQYLQQCPFEDHVKLVNEVTEFAKTCVAD

ESAENCDKSLHTLFGDKLCTVATLRETYGEMADCCAKQEPERNECFLQHKDDNPNLPRL

VRPEVDVMCTAFHDNEETFLKKYLYEIARRHPYFYAPELLFFAKRYKAAFTECCQAADK
```

-continued

```
AACLLPKLDELRDEGKASSAKQRLKCASLQKFGERAFKAWAVARLSQRFPKAEFAEVSK

LVTDLTKVHTECCHGDLLECADDRADLAKYICENQDSISSKLKECCEKPLLEKSHCIAEV

ENDEMPADLPSLAADFVESKDVCKNYAEAKDVFLGMFLYEYARRHPDYSVVLLLRLAK

TYETTLEKCCAAADPHECYAKVFDEFKPLVEEPQNLIKQNCELFEQLGEYKFQNALLVR

YTKKVPQVSTPTLVEVSRNLGKVGSKCCKHPEAKRMPCAEDYLSVVLNQLCVLHEKTP

VSDRVTKCCTESLVNRRPCFSALEVDETYVPKEFNAETFTFHADICTLSEKERQIKKQTAL

VELVKHKPKATKEQLKAVMDDFAAFVEKCCKADDKETCFAEEGKKLVAASQAALGL;
or
```

(SEQ ID NO: 407)
FVNQHLC$_{[1]}$GSHLVEALYLVC$_{[2]}$GERGFFYTPKTGSGSSSAAAPQTGIVEQC$_{[3]}$C$_{[4]}$TSIC$_{[5]}$SLYQLENYC$_{[6]}$NGGGGSGGGGSRPSGRKSSKMQAFRIWDVNQKTFYLRNNQLVAGYL

QGPNVNLEEKIDVVPIEPHALFLGIHGGKMX$_{IL66}$LSX$_{IL69}$VKSGDETRLQLEAVNITDLSEN

RKQDKRFAFIRSDSGPTTSFESAAX$_{IL116}$PGWFLX$_{IL122}$TAMEADQPVSLTNMPDEGVMVTK

```
FYFQEDEGGGGSGGGGSDAHKSEVAHRFKDLGEENFKALVLIAFAQYLQQCPFEDHVKL

VNEVTEFAKTCVADESAENCDKSLHTLFGDKLCTVATLRETYGEMADCCAKQEPERNEC

FLQHKDDNPNLPRLVRPEVDVMCTAFHDNEETFLKKYLYEIARRHPYFYAPELLFFAKRY

KAAFTECCQAADKAACLLPKLDELRDEGKASSAKQRLKCASLQKFGERAFKAWAVARL

SQRFPKAEFAEVSKLVTDLTKVHTECCHGDLLECADDRADLAKYICENQDSISSKLKECC

EKPLLEKSHCIAEVENDEMPADLPSLAADFVESKDVCKNYAEAKDVFLGMFLYEYARRH

PDYSVVLLLRLAKTYETTLEKCCAAADPHECYAKVFDEFKPLVEEPQNLIKQNCELFEQL

GEYKFQNALLVRYTKKVPQVSTPTLVEVSRNLGKVGSKCCKHPEAKRMPCAEDYLSVV

LNQLCVLHEKTPVSDRVTKCCTESLVNRRPCFSALEVDETYVPKEFNAETFTFHADICTL

SEKERQIKKQTALVELVKHKPKATKEQLKAVMDDFAAFVEKCCKADDKETCFAEEGKKL

VAASQAALGL;
or
```

(SEQ ID NO: 408)
X$_{IL0}$RPSGRKSSKNIQAFRIWDVNQKTFYLRNNQLVAGYLQGPNVNLEEKIDVVPIEP

HALFLGIHGGKMX$_{IL66}$LSX$_{IL69}$VKSGDETRLQLEAVNITDLSENRKQDKRFAFIRSDSGPTT

SFESAAX$_{IL116}$PGWFLX$_{IL122}$TAMEADQPVSLTNMPDEGVMVTKFYFQEDE-(GGGGS)$_m$-DA

```
HKSEVAHRFKDLGEENFKALVLIAFAQYLQQCPFEDHVKLVNEVTEFAKTCVADESAEN

CDKSLHTLFGDKLCTVATLRETYGEMADCCAKQEPERNECFLQHKDDNPNLPRLVRPEV

DVMCTAFHDNEETFLKKYLYEIARRHPYFYAPELLFFAKRYKAAFTECCQAADKAACLL

PKLDELRDEGKASSAKQRLKCASLQKFGERAFKAWAVARLSQRFPKAEFAEVSKLVTDL

TKVHTECCHGDLLECADDRADLAKYICENQDSISSKLKECCEKPLLEKSHCIAEVENDE

MPADLPSLAADFVESKDVCKNYAEAKDVFLGMFLYEYARRHPDYSVVLLLRLAKTYET

TLEKCCAAADPHECYAKVFDEFKPLVEEPQNLIKQNCELFEQLGEYKFQNALLVRYTKK

VPQVSTPTLVEVSRNLGKVGSKCCKHPEAKRMPCAEDYLSVVLNQLCVLHEKTPVSDR

VTKCCTESLVNRRPCFSALEVDETYVPKEFNAETFTFHADICTLSEKERQIKKQTALVELV
```

KHKPKATKEQLKAVMDDFAAFVEKCCKADDKETCFAEEGKKLVAASQAALGL-(GGGG
S)$_n$-FVNQHLC$_{[1]}$GSHLVEALYLVC$_{[2]}$GERGFFYTPKT-C$_L$-GIVEQC$_{[3]}$C$_{[4]}$TSIC$_{[5]}$SLYQ
LENYC$_{[6]}$N;
or (SEQ ID NO: 409)
X$_{IL0}$RPSGRKSSKNIQAFRIWDVNQKTFYLRNNQLVAGYLQGPNVNLEEKIDVVPIEP
HALFLGIHGGKMX$_{IL66}$LSX$_{IL69}$VKSGDETRLQLEAVNITDLSENRKQDKRFAFIRSDSGPTT
SFESAAX$_{IL116}$PGWFLX$_{IL122}$TAMEADQPVSLTNMPDEGVMVTKFYFQEDE-(GGGGS)$_m$-FV
NQHLC$_{[1]}$GSHLVEALYLVC$_{[2]}$GERGFFYTPKT-C$_L$-GIVEQC$_{[3]}$C$_{[4]}$TSIC$_{[5]}$SLYQLENY
C$_{[6]}$N-(GGGGS)$_n$-DAHKSEVAHRFKDLGEENFKALVLIAFAQYLQQCPPEDHVKLVNEVTEFA
KTCVADESAENCDKSLHTLFGDKLCTVATLRETYGEMADCCAKQEPERNECFLQHKDDNP
NLPRLVRPEVDVMCTAFHDNEETFLKKYLYEIARRHPYFYAPELLFFAKRYKAAFTECCQ
AADKAACLLPKLDELRDEGKASSAKQRLKCASLQKFGERAFKAWAVARLSQRFPKAEF
AEVSKLVTDLTKVHTECCHGDLLECADDRADLAKYICENQDSISSKLKECCEKPLLEKS
HCIAEVENDEMPADLPSLAADFVESKDVCKNYAEAKDVFLGMFLYEYARRHPDYSVVL
LLRLAKTYETTLEKCCAAADPHECYAKVFDEFKPLVEEPQNLIKQNCELFEQLGEYKFQ
NALLVRYTKKVPQVSTPTLVEVSRNLGKVGSKCCKHPEAKRMPCAEDYLSVVLNQLCV
LHEKTPVSDRVTKCCTESLVNRRPCFSALEVDETYVPKEFNAETFTFHADICTLSEKERQI
KKQTALVELVKHKPKATKEQLKAVMDDFAAFVEKCCKADDKETCFAEEGKKLVAASQA
ALGL;

in each of the above-mentioned fusion proteins, m and n are each 0, 1, 2, 3, 4, 5, or 6 and each of other variables is defined as herein;

IN-68:
(SEQ ID NO: 152)
DAHKSEVAHRFKDLGEENFKALVLIAFAQYLQQCPFEDHVKLVNEV
TEFAKTCVADESAENCDKSLHTLFGDKLCTVATLRETYGEMADCCA
KQEPERNECFLQHKDDNPNLPRLVRPEVDVMCTAFHDNEETFLKKY
LYEIARRHPYFYAPELLFFAKRYKAAFTECCQAADKAACLLPKLDE
LRDEGKASSAKQRLKCASLQKFGERAFKAWAVARLSQRFPKAEFAE
VSKLVTDLTKVHTECCHGDLLECADDRADLAKYICENQDSISSKLK
ECCEKPLLEKSHCIAEVENDEMPADLPSLAADFVESKDVCKNYAEA
KDVFLGMFLYEYARRHPDYSVVLLLRLAKTYETTLEKCCAAADPHE
CYAKVFDEFKPLVEEPQNLIKQNCELFEQLGEYKFQNALLVRYTKK
VVPQVSTPTLVEVSRNLGKVGSKCCKHPEAKRMPCAEDYLSVVLNQ
LCVLHEKTPSDRVTKCCTESLVNRRPCFSALEVDETYVPKEFNAET
FTFHADICTLSEKERQIKKQTALVELVKHKPKATKEQLKAVMDDFA
AFVEKCCKADDKETCFAEEGKKLVAASQAALGLGGGGSGGGGSFVN
QHLC$_{[1]}$GSHLVEALYLVC$_{[2]}$GERGFFYTPKTGSGSSSAAAPQTGIV
EQC$_{[3]}$C$_{[4]}$TSIC$_{[5]}$SLYQLENYC$_{[6]}$NGGGGSGGGGSRPSGRKSSKM
QAPRIWDVNQKTFYLRNNQLVAGYLQGPNVNLEEKIDVVPIEPHAL
FLGIHGGKMCLSCVKSGDETRLQLEAVNITDLSENRKQDKRFAFIR

SDSGPTTSFESAACPGWFLCTAMEADQPVSLTNMPDEGVMVTKFYF
QEDE;

IN-69:
(SEQ ID NO: 153)
DAHKSEVAHRFKDLGEENFKALVLIAFAQYLQQCPFEDHVKLVNEV
TEFAKTCVADESAENCDKSLHTLFGDKLCTVATLRETYGEMADCCA
KQEPERNECFLQHKDDNPNLPRLVRPEVDVMCTAFHDNEETFLKKY
LYEIARRHPYFYAPELLFFAKRYKAAFTECCQAADKAACLLPKLDE
LRDEGKASSAKQRLKCASLQKFGERAFKAWAVARLSQRFPKAEFAE
VSKLVTDLTKVHTECCHGDLLECADDRADLAKYICENQDSISSKLK
ECCEKPLLEKSHCIAEVENDEMPADLPSLAADFVESKDVCKNYAEA
KDVFLGMFLYEYARRHPDYSVVLLLRLAKTYETTLEKCCAAADPHE
CYAKVFDEFKPLVEEPQNLIKQNCELFEQLGEYKFQNALLVRYTKK
VPQVSTPTLVEVSRNLGKVGSKCCKHPEAKRMPCAEDYLSVVLNQL
CVLHEKTPVSDRVTKCCTESLVNRRPCFSALEVDETYVPKEFNAET
FTFHADICTLSEKERQIKKQTALVELVKHKPKATKEQLKAVMDDFA
AFVEKCCKADDKETCFAEEGKKLVAASQAALGLGGGGSGGGGSRPS
GRKSSKMQAFRIWDVNQKTFYLRNNQLVAGYLQGPNVNLEEKIDVV
PIEPHALFLGIHGGKMCLSCVKSGDETRLQLEAVNITDLSENRKQD
KRFAFIRSDSGPTTSFESAACPGWFLCTAMEADQPVSLTNMPDEGV

```
MVTKFYFQEDEGGGGSGGGGSFVNQHLC[1]GSHLVEALYLVC[2]G

ERGFFYTPKTGSGSSSAAAPQTGIVEQC[3]C[4]TSIC[5]SLYQLEN

YC[6]N;

IN-70:
                                    (SEQ ID NO: 154)
MRPSGRKSSKMQAFRIWDVNQKTFYLRNNQLVAGYLQGPNVNLEEK

IDVVPIEPHALFLGIHGGKMCLSCVKSGDETRLQLEAVNITDLSEN

RKQDKRFAFIRSDSGPTTSFESAACPGWFLCTAMEADQPVSLTNMP

DEGVMVTKFYFQEDEGGGGSGGGGSDAHKSEVAHRFKDLGEENFKA

LVLIAFAQYLQQCPFEDHVKLVNEVTEFAKTCVADESAENCDKSLH

TLFGDKLCTVATLRETYGEMADCCAKQEPERNECFLQHKDDNPNLP

RLVRPEVDVMCTAFHDNEETFLKKYLYEIARRHPYFYAPELLFFAK

RYKAAFTECCQAADKAACLLPKLDELRDEGKASSAKQRLKCASLQK

FGERAFKAWAVARLSQRFPKAEFAEVSKLVTDLTKVHTECCHGDLL

ECADDRADLAKYICENQDSISSKLKECCEKPLLEKSHCIAEVENDE

MPADLPSLAADFVESKDVCKNYAEAKDVFLGMFLYEYARRHPDYSV

VLLLRLAKTYETTLEKCCAAADPHECYAKVFDEFKPLVEEPQNLIK

QNCELFEQLGEYKFQNALLVRYTKKVPQVSTPTLVEVSRNLGKVGS

KCCKHPEAKRMPCAEDYLSVVLNQLCVLHEKTPVSDRVTKCCTESL

VNRRPCFSALEVDETYVPKEFNAETFTFHADICTLSEKERQIKKQT

ALVELVKHKPKATKEQLKAVMDDFAAFVEKCCKADDKETCFAEEGK

KLVAASQAALGLGGGGSGGGGSFVNQHLC[1]GSHLVEALYLVC[2]G

ERGFFYTPKTGAGSSSAAAPQTGIVEQC[3]C[4]TSIC[5]SLYQLEN

YC[6]N.
```

(2) A dimeric protein/cross-linking protein of the interleukin-1 receptor antagonistic protein—the linking or spacer group—the insulin receptor binding polypeptide If the insulin receptor binding polypeptide is linked to the linking group via a chemical reaction and further linked to the interleukin-1 receptor antagonistic protein, there is of regularity somewhat in selecting the reactive functional groups and reactive sites on the insulin receptor binding polypeptide.

The human natural insulin has just one lysine at B29. The single chain insulin receptor binding polypeptide is linked to the linking group through the N-terminal α-amino group, the ϵ-amino groups on the side chains of the intrachain or terminal lysines or the mercapto groups on the side chains of the intrachain or terminal cysteines. The double-chain insulin receptor binding polypeptide is linked to the linking group through the N-terminal α-amino group of the B chain, the ϵ-amino group on the side chain of the lysine or the mercapto group on the side chain of the cysteine at the N- or C-terminus of the B chain, or the amino group on the side chain of the lysine or the mercapto group on the side chain of the cysteine at the C-terminus of the A chain.

In one embodiment, the sequence of the fusion protein is (SEQ ID NO: 410)

U$_L$-X$_{IL0}$RPSGRKSSKMQAFRIWDVNQKTFYLRNNQLVAGYLQGPN

VNLEEKIDVVPIEPHALFLGIHGGKMX$_{IL66}$LSX$_{IL69}$VKSGDETRL

QLEAVNITDLSENRKQDKRFAFIRSDSGPTTSFESAAC
(the linking group- the insulin receptor binding polypeptide)

PGWFLX$_{IL122}$TAMEADQPVSLTNMPDEGVMVTKFYFQEDE;
or (SEQ ID NO: 411)

U$_L$-X$_{IL0}$RPSGRKSSKMQAFRIWDVNQKTFYLRNNQLVAGYLQGPN

VNLEEKIDVVPIEPHALFLGIHGGKMX$_{IL66}$LSX$_{IL69}$VKSGDETRL

QLEAVC
(the linking group- the insulin receptor binding polypeptide)

ITDLSENRKQDKRFAFIRSDSGPTTSFESAASPGWFLX$_{IL122}$TAM

EADQPVSLTNMPDEGVMVTKFYFQEDE;
or (SEQ ID NO: 412)

(the insulin receptor binding polypeptide- the linking group)

C$_{IL0}$-X$_{IL0}$RPSGRKSSKMQAFRIWDVNQKTFYLRNNQLVAGYLQGP

NVNLEEKIDVVPIEPHALFLGIHGGKMX$_{IL66}$LSX$_{IL69}$VKSGDETRL

QLEAVX$_{IL84}$ITDLSENRKQDKRFAFIRSDSGPTTSFESAAX$_{IL116}$PG

WFLX$_{IL122}$TAMEADQPVSLTNMPDEGVMVTKFYFQEDE,
or (SEQ ID NO: 413)

UL-X$_{IL0}$RPSGRKSSKMQAFRIWDVNQKTFYLRNNQLVAGYLQGPN

VNLEEKIDVVPIEPHALFLGIHGGKMX$_{IL66}$LSX$_{IL69}$VKSGDETRLQ

LEAVX$_{IL84}$ITDLSENRKQDKRFAFIRSDSGPTTSFESAAX$_{IL116}$PG

WFLX$_{IL122}$TAMEADQPVSLTNMPDEGVMVTKFYFQEDEC$_{IL153}$
(the linking group- the insulin receptor binding polypeptide), In the individual fusion proteins, each of the variables is defined as herein.

In one embodiment, one terminus of the linking group, which is a N-hydroxyl succinimide (NHS ester), is reacted with the amino group on the side chain of a lysine in the insulin receptor binding polypeptide, while the other terminus thereof, which is a modifying group activated by maleimide or iodoethylamide, is reacted with the cysteine at position 0, 6, 8, 9, 84, 116, 141, or 153 in the interleukin-1 receptor antagonistic protein, thereby forming a covalent linkage. In one embodiment, one terminus of the linking group, which is a modifying group activated by maleimide or iodoethylamide, is reacted with the cysteine at position 0, 6, 8, 9, 84, 116, 141, or 153 in the interleukin-1 receptor antagonistic protein to form a covalent linkage, while the other terminus thereof, which is an aldehyde group, is reacted with the amino group at N-terminus of the insulin receptor binding polypeptide, thereby forming a covalent linkage via reductive amination. In one embodiment, one terminus of the linking group, which is a NHS ester, is reacted with the amino group on the side chain of a lysine in the insulin receptor binding polypeptide, while the other terminus thereof, which is an aldehyde group, is reacted with the amino group at N-terminus of theinterleukin-1 receptor binding polypeptide, thereby forming covalent linkages via reductive amination.

The insulin receptor binding polypeptide has the single- or double-chain structure set forth in the invention. In one embodiment, the insulin receptor binding polypeptide is the human natural insulin, the human natural insulin desB30T, lispro insulin, aspart insulin, glulisine insulin, etc. The α-amino group at the N-terminus of the B chain or the ε-amino group on the side chain of an intrachain lysine may be reacted with the NHS ester at one terminus of the linking group.

In one embodiment, the insulin receptor binding polypeptide is a modified conjugate, for example, glargine insulin, insulin detemir, etc.

The single chain insulin receptor binding polypeptide may have one of the following sequences:

(SEQ ID NO: 414)
$U_L$-$X_{IN107}$HLC$_{[1]}$GSX$_{IN108}$LVEALYLVC$_{[2]}$GEX$_{IN109}$GFX$_{IN110}$X$_{IN111}$X$_{IN112}$X$_{IN113}$X$_{IN114}$X$_{IN115}$-$C_L$-GIVEQC$_{[3]}$C$_{[4]}$X$_{IN127}$SICSLYQLENYC$_{[6]}$X$_{IN128}$X$_{IN129}$;
or (SEQ ID NO: 415)
$U_L$-$X_{IN107}$HLC$_{[1]}$GSHLVEALYLVC$_{[2]}$GERGFX$_{IN110}$X$_{IN111}$X$_{IN112}$X$_{IN113}$X$_{IN114}$X$_{IN115}$-$C_L$-GIVEQC$_{[3]}$C$_{[4]}$TSICSLYQLENYC$_{[6]}$X$_{IN128}$X$_{IN129}$;
or (SEQ ID NO: 416)
$U_L$-FVNQHLC$_{[1]}$GSHLVEALYLVC$_{[2]}$GERGFFYTPX$_{IN114}$T-$C_L$-GIVEQC$_{[3]}$C$_{[4]}$TSIC$_{[5]}$SLYQLENYC$_{[6]}$N;
or (SEQ ID NO: 417)
$U_L$-FVNQHLC$_{[1]}$GSHLVEALYLVC$_{[2]}$GERGFFYTPX$_{IN114}$TGKGSSSAAAPQTGIVEQC$_{[3]}$C$_{[4]}$TSIC$_{[5]}$SLYQLENYC$_{[6]}$N;
or (SEQ ID NO: 418)
$U_L$-FVNQHLC$_{[1]}$GSHLVEALYLVC$_{[2]}$GERGFFYTPX$_{IN114}$TGSGKSSAAAPQTGIVEQC$_{[3]}$C$_{[4]}$TSIC$_{[5]}$SLYQLENYC$_{[6]}$N;
or (SEQ ID NO: 419)
$U_L$-FVNQHLC$_{[1]}$GSHLVEALYLVC$_{[2]}$GERGFFYTPX$_{IN114}$TGSGSKSAAAPQTGIVEQC$_{[3]}$C$_{[4]}$TSIC$_{[5]}$SLYQLENYC$_{[6]}$N;
or (SEQ ID NO: 420)
$U_L$-FVNQHLC$_{[1]}$GSHLVEALYLVC$_{[2]}$GERGFFYTPX$_{IN114}$TGSGSSKAAAPQTGIVEQC$_{[3]}$C$_{[4]}$TSIC$_{[5]}$SLYQLENYC$_{[6]}$N;
or (SEQ ID NO: 421)
$U_L$-FVNQHLC$_{[1]}$GSHLVEALYLVC$_{[2]}$GERGFFYTPX$_{IN114}$TGSGSSSKAAPQTGIVEQC$_{[3]}$C$_{[4]}$TSIC$_{[5]}$SLYQLENYC$_{[6]}$N;
or (SEQ ID NO: 422)
$U_L$-FVNQHLC$_{[1]}$GSHLVEALYLVC$_{[2]}$GERGFFYTPX$_{IN114}$TGSGSSSAKAPQTGIVEQC$_{[3]}$C$_{[4]}$TSIC$_{[5]}$SLYQLENYC$_{[6]}$N;
or (SEQ ID NO: 423)
$U_L$-FVNQHLC$_{[1]}$GSHLVEALYLVC$_{[2]}$GERGFFYTPX$_{IN114}$TGSGSSSAAKPQTGIVEQC$_{[3]}$C$_{[4]}$TSIC$_{[5]}$SLYQLENYC$_{[6]}$N;
or (SEQ ID NO: 424)
$U_L$-FVNQHLC$_{[1]}$GSHLVEALYLVC$_{[2]}$GERGFFYTPX$_{IN114}$TGSGSSSAAAPQTGIVEQC$_{[3]}$C$_{[4]}$TSIC$_{[5]}$SLYQLENYC$_{[6]}$NK;
or (SEQ ID NO: 425)
FVNQHLC$_{[1]}$GSHLVEALYLVC$_{[2]}$GERGFFYTPX$_{IN114}$TGSGSSSAAAPQTGIVEQC$_{[3]}$C$_{[4]}$TSIC$_{[5]}$SLYQLENYC$_{[6]}$N;
or (SEQ ID NO: 426)
$U_L$-FVNQHLC$_{[1]}$GSHLVEALYLVC$_{[2]}$GERGFFGSGSSSAAKPQTGIVEQC$_{[3]}$C$_{[4]}$TSIC$_{[5]}$SLYQLENYC$_{[6]}$N;
or (SEQ ID NO: 427)
$U_L$-FVNQHLC$_{[1]}$GSHLVEALYLVC$_{[2]}$GERGFFGSGSSSAKAPQTGIVEQC$_{[3]}$C$_{[4]}$TSIC$_{[5]}$SLYQLENYC$_{[6]}$N;
or (SEQ ID NO: 428)
$U_L$-FVNQHLC$_{[1]}$GSHLVEALYLVC$_{[2]}$GERGFFGSGSSSKAAPQTGIVEQC$_{[3]}$C$_{[4]}$TSIC$_{[5]}$SLYQLENYC$_{[6]}$N;
or (SEQ ID NO: 429)
$U_L$-FVNQHLC$_{[1]}$GSHLVEALYLVC$_{[2]}$GERGFFGSGSSSAAAPQTGIVEQC$_{[3]}$C$_{[4]}$TSIC$_{[5]}$SLYQLENYC$_{[6]}$NK;
or (SEQ ID NO: 430)
FVNQHLC$_{[1]}$GSHLVEALYLVC$_{[2]}$GERGFFGSGSSSAAAPQTGIVEQC$_{[3]}$C$_{[4]}$TSIC$_{[5]}$SLYQLENYC$_{[6]}$N;

The variables in the individual peptides are defined as herein;

The single chain insulin receptor binding polypeptide is linked to the linking group through the α-amino group at the N-terminus or the ε-amino group on the side chain of a lysine.

The interleukin-1 receptor antagonistic protein for forming a dimeric protein/cross-linking protein may be (SEQ ID NO: 431)
$U_L$-RPSGRKSSKNIQAFRIWDVNQKTFYLRNNQLVAGYLQGPNVNLEEKIDVVPIEPHALFLGIHGGKMX$_{IL66}$LSX$_{IL69}$VKSGDETRLQLEAVX$_{IL84}$ITDLSENRKQDKRFAFIRSDSGPTTSFESAAX$_{IL116}$PGWFLX$_{IL122}$TAMEADQPVSLTNMPDEGVMVTKFYFQEDE;
or (SEQ ID NO: 432)
$U_L$-CRPSGRKSSKNIQAFRIWDVNQKTFYLRNNQLVAGYLQGPNVNLEEKIDVVPIEPHALFLGIHGGKMX$_{IL66}$LSX$_{IL69}$VKSGDETRLQLEAVNITDLSENRKQDKRFAFIRSDSGPTTSFESAASPGWFLX$_{IL122}$TAMEADQPVSLTNMPDEGVMVTKFYFQEDE;
or (SEQ ID NO: 433)
$U_L$-RPSGRKSSKNIQAFRIWDVNQKTFYLRNNQLVAGYLQGPNVNLEEKIDVVPIEPHALFLGIHGGKMX$_{IL66}$LSX$_{IL69}$VKSGDETRLQLEAVNITDLSENRKQDKRFAFIRSDSGPTTSFESAASPGWELX$_{IL122}$TAMEADQPVSLTNMPDEGVMVTKFYFQEDEC;

each of the variables in the individual proteins is defined as herein.

The insulin receptor binding polypeptide-a linking or spacer group—the interleukin-1 receptor antagonistic protein may be:

(SEQ ID NO: 434)
(the insulin receptor binding polypeptide-the linking group)

RPSGRKSSKMQAFRIWDV

-continued (SEQ ID NO: 435)
(the insulin receptor binding polypeptide-
the linking group)

CRPSGRKSSKMQAFRIWDVNQKTFYLRNNQLVAGYLQGPNVN

LEEKIDVVPIEPHALFLGIHGGKMX$_{IL66}$LSX$_{IL69}$VKSGDETRL

QLEAVNITDLSENRKQDKRFAFIRSDSGPTTSPESAASPGWF

LX$_{IL122}$TAMEADQPVSLTNMPDEGVMVTKFYFQEDE;

each of the variables in the individual proteins is defined as herein.

The sequences of the dimeric protein/cross-linking protein of the insulin receptor binding polypeptide and the interleukin-1 receptor antagonistic protein are selected from:

IN-29:

(SEQ ID NO: 113)
FVNQHLC$_{[1]}$GSHLVEALYLVC$_{[2]}$GERGFFYTPRTGK
(N$^\epsilon$-PEG12-maleimide-IL-1ra)

GSSSAAAPQTGIVEQC$_{[3]}$C$_{[4]}$TSIC$_{[5]}$SLYQLENYC$_{[6]}$N, wherein the sequence of the IL-1ra is:

(SEQ ID NO: 194)
RPSGRKSSKMQAFRIWDVNQKTFYLRNNQLVAGYLQGPNVNLEEKIDVVP

IEPHALFLGIHGGKMCLSCVKSGDETRLQLEAVNITDLSENRKQDKRFAF

IRSDSGPTTSPESAA<u>C</u>PGWFLCTAMEADQPVSLTNMPDEGVMVTKFYFQE

DE, the N-hydroxylsuccinimide of the linking group, i.e. maleimide-PEG12-NHS, is reacted with the amino group on the side chain of a lysine in the insulin receptor binding polypeptide, and the maleimide is reacted with the mercapto group on the side chain of a cysteine at position 116 underlined in the IL-1ra.

IN-30:

(SEQ ID NO: 114)
FVNQHLC$_{[1]}$GSHLVEALYLVC$_{[2]}$GERGFEYTPRTGK
(N$^\epsilon$-PEG12-maleimide-the interleukin-1 receptor
antagonistic protein)

GSSSAAAPQTGIVEQC$_{[3]}$C$_{[4]}$TSIC$_{[5]}$SLYQLENYC$_{[6]}$N;

in which the sequence of the interleukin-1 receptor antagonistic protein is as follows:

(SEQ ID NO: 195)
RPSGRKSSKMQAFRIWDVNQKTFYLRNNQLVAGYLQGPNVNLEEKIDVV

PIEPHALFLGIHGGKMCLSCVKSGDETRLQLEAV<u>C</u>ITDLSENRKQDKRF

AFIRSDSGPTTSFESAASPGWFLCTAMEADQPVSLTNMPDEGVMVTKFY

FQEDE,

The N-hydroxylsuccinimide of the linking group, i.e. maleimide-PEG12-NHS, is reacted with the amino group on the side chain of a lysine in the insulin receptor binding polypeptide, and the maleimide is reacted with the mercapto group on the side chain of a cysteine at position 84 underlined in the interleukin-1 receptor antagonistic protein.

IN-31:

(SEQ ID NO: 115)
FVNQHLC$_{[1]}$GSHLVEALYLVC$_{[2]}$GERGFEYTPRTGK
(N$^\epsilon$-PEG20K-maleimide-IL-1ra)

GSSSAAAPQTGIVEQC$_{[3]}$C$_{[4]}$TSIC$_{[5]}$SLYQLENYC$_{[6]}$N, in which the sequence of IL-1ra is SEQ ID NO:194 and the N-hydroxylsuccinimide of the linking group, i.e. maleimide-PEG20K-NHS, is reacted with the amino group on the side chain of a lysine in the insulin receptor binding polypeptide, and the maleimide is reacted with the mercapto group on the side chain of a cysteine at position 116 underlined in the IL-1ra.

IN-32:

(SEQ ID NO: 116)
FVNQHLC$_{[1]}$GSHLVEALYLVC$_{[2]}$GERGFFYTPRTGK
(N$^\epsilon$-PEG20K-maleimide-the interleukin-1
receptor antagonistic protein)

GSSSAAAPQTGIVEQC$_{[3]}$C$_{[4]}$TSIC$_{[5]}$SLYQLENYC$_{[6]}$N, in which the sequence of the interleukin-1 receptor antagonistic protein is SEQ ID NO: 195, and the N-hydroxylsuccinimide of the linking group, i.e. maleimide-PEG20K-NHS, is reacted with the amino group on the side chain of a lysine in the insulin receptor binding polypeptide, and the maleimide is reacted with the mercapto group on the side chain of a cysteine at position 84 underlined in the interleukin-1 receptor antagonistic protein.

IN-33:

(SEQ ID NO: 117)
F[N$^\alpha$-(N$^\alpha$-(HOOC(CH$_2$)$_{14}$CO)-γ-L-Glu)]VNQHLC$_{[1]}$ GSHLVEALYLVC$_{[2]}$GERGFFYTPRTGK
(N$^\epsilon$-PEG12-maleimide-IL-1ra)

GSSSAAAPQTGIVEQC$_{[3]}$C$_{[4]}$TSIC$_{[5]}$SLYQLENYC$_{[6]}$N;

in which the sequence of IL-1ra is SEQ ID NO:194 and the N-hydroxylsuccinimide of the linking group, i.e. maleimide-PEG12-NHS, is reacted with the amino group on the side chain of a lysine in the insulin receptor binding polypeptide, and the maleimide is reacted with the mercapto group on the side chain of a cysteine at position 116 underlined in the IL-1ra.

IN-34:

(SEQ ID NO: 118)
F[N$^\alpha$-(N$^\alpha$-(HOOC(CH$_2$)$_{16}$CO)-γ-L-Glu)]VNQHLC$_{[1]}$GS HLVEALYLVC$_{[2]}$GERGFFYTPRTGK
(N$^\epsilon$-PEG12-maleimide-the interleukin-1
receptor antagonistic protein)

GSSSAAAPQTGIVEQC$_{[3]}$C$_{[4]}$TSIC$_{[5]}$SLYQLENYC$_{[6]}$N, in which the sequence of the interleukin-1 receptor antagonistic protein is SEQ ID NO: 195, and the N-hydroxylsuccinimide of the linking group, i.e. maleimide-PEG12-NHS, is reacted with the amino group on the side chain of a lysine in the insulin receptor binding polypeptide, and the maleimide is reacted with the mercapto group on the side chain of a cysteine at position 84 underlined in the interleukin-1 receptor antagonistic protein.

IN-35:
(SEQ ID NO: 119)
RPSGRKSSKMQAFRIWDVNQKTFYLRNNQLVAGYLQGPNVNLEEKID

VVPIEPHALFLGIHGGKMCLSCVKSGDETRLQLEAVNITDLSENRKQ

DKRFAFIRSDSGPTTSFESAAC
(S-maleimide-PEG12-human insulin)

PGWFLCTAMEAD QPVSLTNMPDEGVMVTKFYFQEDE;
(S is the sulphur atom on the side chain of a cysteine residue)

the N-hydroxylsuccinimide of the linking group, i.e. maleimide-PEG12-NHS, is reacted with α-amino group at the N-terminus of the B chain of the human insulin, and the maleimide is reacted with the mercapto group on the side chain of a cysteine at position 116 in the IL-1ra.

IN-36:
(SEQ ID NO: 120)
RPSGRKSSKMQAFRIWDVNQKTFYLRNNQLVAGYLQGPNVNLEEKID

VVPIEPHALFLGIHGGKMCLSCVKSGDETRLQLEAVNITDLSENRKQ

DKRFAFIRSDSGPTTSFESAAC
(S-maleimide-PEG12-the insulin receptor binding polypeptide)

PGWFLCTAMEADQPVSLTNMPDEGVMV TKFYFQEDE,
(S is the sulphur atom on the side chain of a cysteine residue)

the N-hydroxylsuccinimide of the linking group, i.e. maleimide-PEG12-NHS, is reacted with the α-amino group at the N-terminus of the insulin receptor binding polypeptide $N^{\epsilon B29}$—($N^{\alpha}$—(HOOC(CH$_2$)$_{14}$CO)-γ-Glu)des (B30)—the B chain of the human insulin, and the maleimide is reacted with the mercapto group on the side chain of a cysteine at position 116 in the IL-1ra.

IN-37:
(SEQ ID NO: 121)
RPSGRKSSKMQAFRIWDVNQKTFYLRNNQLVAGYLQGPNVNLEEKID

VVPIEPHALFLGIHGGKMCLSCVKSGDETRLQLEAVNITDLSENRKQ

DKRFAFIRSDSGPTTSFESAAC
(S-maleimide-PEG20K-human insulin)

PGWFLCTAMEADQPVSLTNMPDEGVMVTKFYFQEDE;
(S is the sulphur atom on the side chain of a cysteine residue)

the N-hydroxylsuccinimide of the linking group, i.e. maleimide-PEG20K-NHS, is reacted with α-amino group at the N-terminus of the B chain of the human insulin, and the maleimide is reacted with the mercapto group on the side chain of a cysteine at position 116 in the IL-1ra.

IN-38:
(SEQ ID NO: 122)
RPSGRKSSKMQAFRIWDVNQKTFYLRNNQLVAGYLQGPNVNLEEKID

VVPIEPHALFLGIHGGKMCLSCVKSGDETRLQLEAVC
(S-maleimide-PEG 12-human insulin)

ITDLSENRK QDKRFAFIRSDSGPTTSFESAASPGWFLCTAMEADQP

VSLTNMPDEGVMVTKFYFQEDE;
(S is the sulphur atom on the side chain of a cysteine residue)

in which the N-hydroxylsuccinimide of the linking group, i.e. maleimide-PEG12-NHS, is reacted with α-amino group at the N-terminus of the B chain of the human insulin, and the maleimide is reacted with the mercapto group on the side chain of a cysteine at position 84 in the interleukin-1 receptor antagonistic protein.

IN-39:
(SEQ ID NO: 123)
RPSGRKSSKMQAFRIWDVNQKTFYLRNNQLVAGYLQGPNVNLEEKID

VVPIEPHALFLGIHGGKMCLSCVKSGDETRLQLEAVC
(S-maleimide-PEG 20K-human insulin)

ITDLSEN-RKQDKRFAFIRSDSGPTTSFESAASPGWFLCTAMEADQP

VSLTNMPDEGVMVTKFYFQEDE;
(S is the sulphur atom on the side chain of a cysteine residue)

in which the N-hydroxylsuccinimide of the linking group, i.e. maleimide-PEG20K-NHS, is reacted with α-amino group at the N-terminus of the B chain of the human insulin, and the maleimide is reacted with the mercapto group on the side chain of a cysteine at position 84 in the interleukin-1 receptor antagonistic protein.

IN-40:
(SEQ ID NO: 124)
RPSGRKSSKMQAFRIWDVNQKTFYLRNNQLVAGYLQGPNVNLEEKID

VVPIEPHALFLGIHGGKMCLSCVKSGDETRLQLEAVC
(S-maleimide-PEG12-the insulin receptor binding polypeptide)

ITDLSENRKQDKRFAFIRSDSGPTTSFESAASPGWF LCTAMEADQP

VSLTNMPDEGVMV TKFYFQEDE;
(S is the sulphur atom on the side chain of a cysteine residue)

in which the N-hydroxylsuccinimide of the linking group, i.e. maleimide-PEG12-NHS, is reacted with the α-amino group at the N-terminus of the insulin receptor binding polypeptide $N^{\epsilon B29}$—($N^{\alpha}$—(HOOC(CH$_2$)$_{14}$CO)-γ-Glu)des (B30)—the B chain of the human insulin, and the maleimide is reacted with the mercapto group on the side chain of a cysteine at position 84 in the interleukin-1 receptor antagonistic protein.

IN-41:
(SEQ ID NO: 125)
RPSGRKSSKMQAFRIWDVNQKTFYLRNNQLVAGYLQGPNVNLEEKID

VVPIEPHALFLGIHGGKMCLSCVKSGDETRLQLEAVNITDLSENRKQ

DKRFAFIRSDSGPTTSFESAAC
(S-maleimide-PEG12-human insulin desB30T)

PGWFLCTAMEADQPVSLTNMPDEGV MVTKFYFQEDE;
(S is the sulphur atom on the side chain of a cysteine residue)

in which the N-hydroxylsuccinimide of the linking group, i.e. maleimide-PEG12-NHS, is reacted with the ε-amino group of a lysine in the human insulin desB30T B29, and the maleimide is reacted with the mercapto group on the side chain of a cysteine at position 116 in the IL-1ra.

IN-42:
(SEQ ID NO: 126)
RPSGRKSSKMQAFRIWDVNQKTFYLRNNQLVAGYLQGPNVNLEEKID

VVPIEPHALFLGIHGGKMCLSCVKSGDETRLQLEAVNITDLSENRKQ

DKRFAFIRSDSGPTTSFESAAC
(S-maleimide-PEG20K-human insulin desB30T)

```
PGWFLCTAMEADQPVSLTNMPDEGVMVTKFYFQEDE;
```
(S is the sulphur atom on the side chain of a cysteine residue)

in which the N-hydroxylsuccinimide of the linking group, i.e. maleimide-PEG12-NHS, is reacted with the g-amino group of a lysine in the human insulin desB30T B29, and the maleimide is reacted with the mercapto group on the side chain of a cysteine at position 116 in the IL-1ra.

IN-43:
(SEQ ID NO: 127)
```
RPSGRKSSKMQAFRIWDVNQKTFYLRNNQLVAGYLQGPNVNLEEKID

VVPIEPHALFLGIHGGKMCLSCVKSGDETRLQLEAVC
```
(S-maleimide-PEG 12-human insulin desB30T)
```
ITDLSENRKQDKRFAFIRSDSGPTTSFESAASPG WFLCTA MEADQ PVSLTNMPDEGVMVTKFYFQEDE,
```
(S is the sulphur atom on the side chain of a cysteine residue)

in which the N-hydroxylsuccinimide of the linking group, i.e. maleimide-PEG12-NHS, is reacted with the ε-amino group of a lysine in the human insulin desB30T B29, and the maleimide is reacted with the mercapto group on the side chain of a cysteine at position 84 in the interleukin-1 receptor antagonistic protein.

IN-44:
(SEQ ID NO: 128)
```
RPSGRKSSKMQAFRIWDVNQKTFYLRNNQLVAGYLQGPNVNLEEKID

VVPIEPHALFLGIHGGKMCLSCVKSGDETRLQLEAVC
```
(S-maleimide-PEG 20K-human insulin desB30T)
```
ITDLSENRKQDKRFAFIRSDSGPTTSFESAASPG WFLCTAMEADQP VSLTNMPDEGVMVTKFYFQEDE,
```
(S is the sulphur atom on the side chain of a cysteine residue)

in which the N-hydroxylsuccinimide of the linking group, i.e. maleimide-PEG20K-NHS, is reacted with the ε-amino group of a lysine in the human insulin desB30T B29, and the maleimide is reacted with the mercapto group on the side chain of a cysteine at position 84 in the interleukin-1 receptor antagonistic protein.

IN-45:
(SEQ ID NO: 129)
```
FVNQHLC[1]GSHLVEALYLVC[2]GERGFFYTPRTGSGSSSAAAPQTG

IVEQC[3]C[4]TSIC[5]SLYQLENYC[6]NK,
```
(N$^\epsilon$-PEG12-maleimide-IL-1ra)

wherein the sequence of the IL-1ra is SEQ ID NO:194;

in which the N-hydroxylsuccinimide of the linking group, i.e. maleimide-PEG12-NHS, is reacted with the ε-amino group on the side chain of a lysine at the C-terminus of the single chain insulin, and the maleimide is reacted with the mercapto group on the side chain of a cysteine at position 116 underlined in the IL-1ra.

IN-46:
(SEQ ID NO: 130)
```
FVNQHLC[1]GSHLVEALYLVC[2]GERGFFYTPRTGSGSSSAAAPQTG

IVEQC[3]C[4]TSIC[5]SLYQLENYC[6]NK,
```
(N$^\epsilon$-PEG20K-maleimide-IL-1ra)

wherein the sequence of the IL-1ra is SEQ ID NO:194;

the N-hydroxylsuccinimide of the linking group, i.e. maleimide-PEG20K-NHS, is reacted with the ε-amino group on the side chain of a lysine at the C-terminus of the single chain insulin, and the maleimide is reacted with the mercapto group on the side chain of a cysteine at position 116 underlined in the IL-1ra.

IN-47:
(SEQ ID NO: 131)
```
FVNQHLC[1]GSHLVEALYLVC[2]GERGFFYTPRTGSGSSSAAA

PQTGIVEQC[3]C[4]TSIC[5]SLYQLENYC[6]NK
```
(N$^\epsilon$-PEG12-maleimide-the interleukin-1 receptor antagonistic protein), the sequence of the interleukin-1 receptor antagonistic protein is SEQ ID NO:195;

in which the N-hydroxylsuccinimide of the linking group, i.e. maleimide-PEG12-NHS, is reacted with the ε-amino group on the side chain of a lysine at the C-terminus of the single chain insulin, and the maleimide is reacted with the mercapto group on the side chain of a cysteine at position 84 underlined in the interleukin-1 receptor antagonistic protein.

IN-48:
(SEQ ID NO: 132)
```
FVNQHLC[1]GSHLVEALYLVC[2]GERGFFYTPRTGSGSSSAAA

PQTGIVEQC[3]C[4]TSIC[5]SLYQLENYC[6]NK
```
(N$^\epsilon$-PEG20K-maleimide-the interleukin-1 receptor antagonistic protein), the sequence of the interleukin-1 receptor antagonistic protein is SEQ ID NO: 195, and the N-hydroxylsuccinimide of the linking group, i.e. maleimide-PEG20K-NHS, is reacted with the ε-amino group on the side chain of a lysine at C-terminus of the single chain insulin, and the maleimide is reacted with the mercapto group on the side chain of a cysteine at position 84 underlined in the interleukin-1 receptor antagonistic protein.

IN-49:
(SEQ ID NO:133)
```
F(N$^\alpha$-PEG12-maleimide-IL-1ra)VNQHLC[1]GSHLVEA

LYLVC[2]GERGFFYTPRTGSGSSSAAAPQTGIVEQC[3]C[4]TS

IC[5]SLYQLENYC[6]N,
```
wherein the sequence of the IL-1ra is (SEQ ID NO: 196)
```
CRPSGRKSSKMQAFRIWDVNQKTFYLRNNQLVAGYLQGPNVNLEE

KIDVVPIEPHALFLGIHGGKMCLSCVKSGDETRLQLEAVNITDLS

ENRKQDKRFAFIRSDSGPTTSFESAASPGWFLCTAMEADQPVSLT
```

-continued
NMPDEGVMVTKFYFQEDE;

the N-hydroxylsuccinimide of the linking group, i.e. maleimide-PEG12-NHS, is reacted with α-amino group at the N-terminus of the single chain insulin, and the maleimide is reacted with the mercapto group on the side chain of a cysteine at the N-terminus of the interleukin-1 receptor antagonistic protein.

IN-50:
(SEQ ID NO: 134)
F($N^{\alpha}$-PEG20K-maleimide-IL-1ra)VNQHLC$_{[1]}$GSHLVEA

LYLVC$_{[2]}$GERGFFYTPRTGSGSSSAAAPQTGIVEQC$_{[3]}$C$_{[4]}$TSI

C$_{[5]}$SLYQLENYC$_{[6]}$N-, wherein the sequence of the IL-1ra is SEQ ID NO:196;

the N-hydroxylsuccinimide of the linking group, i.e. maleimide-PEG20K-NHS, is reacted with the α-amino group at the N-terminus of the single chain insulin, and the maleimide is reacted with the mercapto group on the side chain of a cysteine at the N-terminus of the interleukin-1 receptor antagonistic protein.

IN-51:
(SEQ ID NO: 135)
FVNQHLC$_{[1]}$GSHLVEALYLVC$_{[2]}$GERGFFYTPRTGK($N^{\epsilon}$-PEG12- maleimide-the interleukin-1 receptor antagonistic protein)GSSSAAAPQTGIVEQC$_{[3]}$C$_{[4]}$TSIC$_{[5]}$SLYQLENYC$_{[6]}$N-, in which the sequence of the interleukin-1 receptor antagonistic protein is SEQ ID NO: 196; the N-hydroxylsuccinimide of the linking group, i.e. maleimide-PEG12-NHS, is reacted with the ε-amino group on the side chain of a lysine in the single chain insulin, and the maleimide is reacted with the mercapto group on the side chain of a cysteine at the N-terminus of the interleukin-1 receptor antagonistic protein.

IN-52:
(SEQ ID NO: 136)
FVNQHLC$_{[1]}$GSHLVEALYLVC$_{[2]}$GERGFFYTPRTGK ($N^{\epsilon}$-PEG20K-maleimide-the interleukin-1 receptor antagonistic protein)GSSSAAAPQTGIVEQC$_{[3]}$C$_{[4]}$

TSIC$_{[5]}$SLYQLEN-YC$_{[6]}$N;

in which the sequence of the interleukin-1 receptor antagonistic protein is SEQ ID NO: 196;

in which the N-hydroxylsuccinimide of the linking group, i.e. maleimide-PEG20K-NHS, is reacted with the ε-amino group on the side chain of a lysine in the single chain insulin, and the maleimide is reacted with the mercapto group on the side chain of a cysteine at the N-terminus of the interleukin-1 receptor antagonistic protein.

IN-53:
(SEQ ID NO: 137)
FVNQHLC$_{[1]}$GSHLVEALYLVC$_{[2]}$GERGFFYTPRTGSGSSSAK ($N^{\epsilon}$-PEG12-maleimide-the interleukin-1 receptor antagonistic protein)APQTGIVEQC$_{[3]}$C$_{[4]}$TSIC$_{[5]}$

SLYQLENYC$_{[6]}$N, in which the sequence of the interleukin-1 receptor antagonistic protein is SEQ ID NO: 196;
in which the N-hydroxylsuccinimide of the linking group, i.e. maleimide-PEG12-NHS, is reacted with the ε-amino group on the side chain of a lysine in the single chain insulin, and the maleimide is reacted with the mercapto group on the side chain of a cysteine at the N-terminus of the interleukin-1 receptor antagonistic protein.

IN-54:
(SEQ ID NO: 138)
FVNQHLC$_{[1]}$GSHLVEALYLVC$_{[2]}$GERGFFYTPRTGSGSSSAK ($N^{\epsilon}$-PEG20K-maleimide-the interleukin-1 receptor antagonistic protein)APQTGIVEQC$_{[3]}$C$_{[4]}$TSIC$_{[5]}$

SLYQLENYC$_{[6]}$N, in which the sequence of the interleukin-1 receptor antagonistic protein is SEQ ID NO: 196;
in which the N-hydroxylsuccinimide of the linking group, i.e. maleimide-PEG20K-NHS, is reacted with the ε-amino group on the side chain of a lysine in the single chain insulin, and the maleimide is reacted with the mercapto group on the side chain of a cysteine at the N-terminus of the interleukin-1 receptor antagonistic protein.

IN-55:
(SEQ ID NO: 139)
FVNQHLC$_{[1]}$GSHLVEALYLVC$_{[2]}$GERGFFGSGSSSAK ($N^{\epsilon}$-PEG12-maleimide-IL-1ra)APQTGIVEQC$_{[3]}$

C$_{[4]}$TSIC$_{[5]}$SLYQLENYC$_{[6]}$N, in which the sequence of the IL-1ra is SEQ ID NO:194,
the N-hydroxylsuccinimide of the linking group, i.e. maleimide-PEG12-NHS, is reacted with the amino group on the side chain of a lysine in the insulin receptor binding polypeptide, and the maleimide is reacted with the mercapto group on the side chain of a cysteine at position 116 underlined in the IL-1ra.

IN-56:
(SEQ ID NO: 140)
FVNQHLC$_{[1]}$GSHLVEALYLVC$_{[2]}$GERGFFGSGSSSAK ($N^{\epsilon}$-PEG12-maleimide-the interleukin-1 receptor antagonistic protein)APQTGIVEQC$_{[3]}$C$_{[4]}$

TSIC$_{[5]}$SLYQLENYC$_{[6]}$N, in which the sequence of the interleukin-1 receptor antagonistic protein is SEQ ID NO:195, and the N-hydroxylsuccinimide of the linking group, i.e. maleimide-PEG12-NHS, is reacted with the amino group on the side chain of a lysine in the insulin receptor binding polypeptide, and the maleimide is reacted with the mercapto group on the side chain of a cysteine at position 84 underlined in the interleukin-1 receptor antagonistic protein.

IN-57:
(SEQ ID NO: 141)
C(S-maleimide-PEG12-human insulin)RPSGRKSSKMQA

FRIWD VNQKTFYLRNNQLVA GYLQGPNVNLEEKIDVVPIEPHAL

-continued

FLGIHGGKMCLSCVKSGDETRLQLEAVNITDLSENRKQDKRFAFIR

SDSGPTTSFESAASPGWFLCTAMEADQPVSLTNMPDEGVMVTKFYF

QEDE (S is the sulphur atom on the side chain of a cysteine residue), the N-hydroxylsuccinimide of the linking group, i.e. maleimide-PEG12-NHS, is reacted with α-amino group at the N-terminus of the B chain of the human insulin, and the maleimide is reacted with the mercapto group on the side chain of a cysteine at the N-terminus of the interleukin-1 receptor antagonistic protein.

IN-58:

(SEQ ID NO: 142)

C(S-maleimide-PEG12-the insulin receptor binding polypeptide)RPSGRKSSKMQAFRIWDVNQKTFYLR

NNQLVAGYLQGPNVNLEEKIDVVPIEPHALFLGIHGGKMCLSCVKS

GDETRLQLEAVNITDLSENRKQDKRFAFIRSDSGPTTSFESAASPG

WFLCTAMEADQPVSLTNMPDEGVMVTKFYFQEDE, (S is the sulphur atom on the side chain of a cysteine residue)

the N-hydroxylsuccinimide of the linking group, i.e. maleimide-PEG12-NHS, is reacted with the α-amino group at the N-terminus of the insulin receptor binding polypeptide $N^{\epsilon B29}$—($N^{\alpha}$—($HOOC(CH_2)_{14}CO$)-γ-Glu)des (B30)—the B chain of the human insulin, and the maleimide is reacted with the mercapto group on the side chain of a cysteine at the N-terminus of the interleukin-1 receptor antagonistic polypeptide.

IN-59:

(SEQ ID NO: 143)

C(S-maleimide-PEG12-human insulin desB30T)RPSG

RKSSKMQAPRIWDVNQKTFYLRNNQLVAGYLQGPNVNLEEKIDVVP

IEPHALFLGIHGGKMCLSCVKSGDETRLQLEAVNITDLSENRKQDK

RFAFIRSDSGPTTSEESAASPGWFLCTAMEADQPVSLTNMPDEGVM

VTKFYFQEDE, (S is the sulphur atom on the side chain of a cysteine residue)

the N-hydroxylsuccinimide of the linking group, i.e. maleimide-PEG12-NHS, is reacted with the ε-amino group on the side chain of a lysine in the human insulin desB30T B29, and the maleimide is reacted with the mercapto group on the side chain of a cysteine at the N-terminus of the interleukin-1 receptor antagonistic polypeptide.

IN-60:

(SEQ ID NO: 144)

MRPSGRKSSKMQAFRIWDVNQKTFYLRNNQLVAGYLQGPNVNLEEK

IDVVPIEPHALFLGIHGGKMCLSCVKSGDETRLQLEAVNITDLSEN

RKQDKRFAFIRSDSGPTTSFESAASPGWELCTAMEADQPVSLTNMP

DEGVMVTKEYFQEDEC(S-maleimide-PEG12-human insulin), (S is the sulphur atom on the side chain of a cysteine residue)

the N-hydroxylsuccinimide of the linking group, i.e. maleimide-PEG12-NHS, is reacted with α-amino group at the N-terminus of the B chain of the human insulin, and the maleimide is reacted with the mercapto group on the side chain of a cysteine at the C-terminus of the interleukin-1 receptor antagonistic protein.

IN-61:

(SEQ ID NO: 145)

MRPSGRKSSKMQAFRIWDVNQKTFYLRNNQLVAGYLQGPNVNLEEK

IDVVPIEPHALFLGIHGGKMCLSCVKSGDETRLQLEAVNITDLSEN

RKQDKRFAFIRSDSGPTTSFESAASPGWFLCTAMEADQPVSLTNMP

DEGVMVTKFYFQEDEC, (S-maleimide-PEG12-human insulin desB30T)

(S is the sulphur atom on the side chain of a cysteine residue)

the N-hydroxylsuccinimide of the linking group, i.e. maleimide-PEG12-NHS, is reacted with the ε-amino group on the side chain of a lysine in the human insulin desB30T B29, and the maleimide is reacted with the mercapto group on the side chain of a cysteine at the C-terminus of the interleukin-1 receptor antagonistic polypeptide.

In the sequences of this section, [1] to [6] indicate the Nos. of the cysteines; 3 pairs of disulfide bonds are formed by six cysteines in the compound, in which the A chain and the B chain are connected by two pairs of interchain disulfide bonds, a pair of intrachain disulfide bond is present in the A chain, and the specific positions for the three pairs of the disulfide bonds are: $C_{[1]}$ and $C_{[4]}$ forming a disulfide bond, $C_{[2]}$ and $C_{[6]}$ forming a disulfide bond, and $C_{[3]}$ and $C_{[5]}$ forming a disulfide bond.

The structure of the reagent of maleimide-PEG12-NHS is shown as follows:

The structure of the reagent after reacted with the interleukin-1 receptor antagonistic protein and the insulin receptor binding polypeptide is shown as follows:

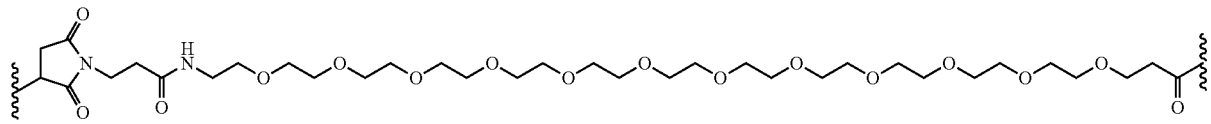 [SMILES: *C(=O)CCOCCOCCOCCOCCOCCOCCOCCOCCOCCOCCOCCOCCNC(=O)CCN1C(=O)CC(*)C1=O]

3. The Fusion Protein Consisting of the GIP Receptor Binding Polypeptide and the Interleukin-1 Receptor Antagonistic Protein In one embodiment, the sequence of the GIP receptor binding polypeptide is (SEQ ID NO: 439)
$(X_{GI1}X_{GI2}X_{GI3}GT)_{t0}X_{GI6}X_{GI7}SDX_{GI10}SX_{GI12}X_{GI13}X_{GI14}DX_{GI16}X_{GI17}$
$X_{GI18}QX_{GI20}X_{GI21}FX_{GI23}X_{GI24}WLX_{GI27}X_{GI28}X_{GI29}X_{GI30}X_{GI31}X_{GI32}$
$X_{GI33}X_{GI34}X_{GI35}X_{GI36}X_{GI37}X_{GI38}X_{GI39}X_{GI40}X_{GI41}X_{GI42}X_{GI43}$, wherein, $X_{GI1}$ is a tyrosine, N-acetyl tyrosine, pyroglutamyl-tyrosine, glucitol-tyrosine, D-histidine, α, α-2 methylimidazolyl acetic acid (DMIA), N-methylhistidine, α-methylhistidine, imidazole acetic acid, deamino-histidine, hydroxylhistidine, acetylhistidine, homohistidine, N-palmitic acid-tyrosine, N-Fmoc-tyrosine, or absent; $X_{GI2}$ is an alanine, D-alanine, D-serine, serine, valine, glycine, N-methylserine, N-methylalanine, 2-methylalanine, or absent; $X_{GI3}$ is a glutamic acid, hydroxyl proline, proline, or absent; $X_{GI6}$ is a phenylalanine, or absent; $X_{GI7}$ is an isoleucine, or threonine; $X_{GI10}$ is a tyrosine, tryptophan, phenylalanine, valine, lysine, ornithine, glutamic acid, leucine, general formula 1, or general formula 2; $X_{GI12}$ is an isoleucine, serine, lysine, arginine, general formula 1, or general formula 2; $X_{GI13}$ is an alanine, glutamine, or tyrosine; $X_{GI14}$ is a methionine or leucine; $X_{GI16}$ is a lysine, arginine, serine, glutamic acid, glutamine, homoglutamic acid, homocysteine, threonine, glycine, 2-methylalanine, general formula 1, or general formula 2; $X_{GI17}$ is an isoleucine, glutamine, glutamic acid, arginine, general formula 1, or general formula 2; $X_{GI18}$ is a histidine, alanine, arginine, serine, threonine, or glycine; $X_{GI20}$ is a glutamine, lysine, alanine, serine, threonine, citrulline, arginine, ornithine, 2-methylalanine, other α,α-disubstituted amino acids, general formula 1, or general formula 2; $X_{GI21}$ is an aspartic acid, glutamic acid, homoglutamic acid, homocysteine, leucine, general formula 1, or general formula 2; $X_{GI23}$ is a valine, or isoleucine; $X_{GI24}$ is a glutamine, glutamic acid, asparagine, alanine, serine, threonine, 2-methylalanine, general formula 1, or general formula 2; $X_{GI27}$ is a leucine, isoleucine, norleucine, lysine, valine, methionine, general formula 1, or general formula 2; $X_{GI28}$ is a glycine, alanine, lysine, asparagine, general formula 1, or general formula 2; $X_{GI29}$ is a glutamine, glycine, threonine, alanine, general formula 1, or general formula 2; $X_{GI30}$ is a lysine, arginine, glycine, general formula 1, or general formula 2; $X_{GI31}$ is a —NH$_2$, glycine, proline, or absent; $X_{GI32}$ is a lysine, arginine, serine, general formula 1, general formula 2, or absent; $X_{G33}$ is a lysine, arginine, serine, general formula 1, general formula 2, or absent; $X_{GI34}$ is an asparagine, glycine, or absent; $X_{GI35}$ is an asparagine, alanine, or absent; $X_{GI36}$ is a tryptophan, proline, or absent; $X_{GI37}$ is a lysine, arginine, proline, general formula 1, general formula 2, or absent; $X_{GI38}$ is a histidine, proline, or absent; $X_{GI39}$ is an asparagine, serine, or absent; $X_{GI40}$ is an isoleucine, —NH$_2$, general formula 1, general formula 2, or absent; $X_{GI41}$ is a threonine or absent; $X_{GI42}$ is a glutamine or absent; $X_{GI43}$ is a lysine, cysteine, PSSGAPPPS (SEQ ID NO:438), general formula 3, general formula 4, or absent; t0 is 0 or 1.

In one embodiment, the sequence from positions 31-42 in the GIP can be deleted by 1-12 of amino acid residues starting from the C-terminus. In one embodiment, the sequence from positions 31-42 in the GIP can be substituted with PSSGAPPPS (SEQ ID NO:438), GPSSGAPPPS (SEQ ID NO:437), $X_{GI}$PSSGAPPPS (SEQ ID NO:440), PSSGAPPPX$_{GI}$-NH$_2$ (SEQ ID NO:441), PSSGAPPPSX$_{GI}$-NH$_2$ (SEQ ID NO:442), in which $X_{GI}$ is general formula 1 or general formula 2.

The GIP receptor binding polypeptide and the interleukin-1 receptor antagonistic protein are able to protect pancreas islet β-cells by similar or distinct mechanisms, thereby treating diabetes mellitus. Accordingly, the fusion protein, dimeric protein or cross-linking protein formed by joining the two compounds may attain a therapeutic effect more excellent than that with either of the compounds alone, due to the synergistic effect by the two compounds. Furthermore, one of the tissues in which the GIP receptors are mainly distributed is the pancreatic islet. The GIP receptor binding polypeptide can serve as a target for the fusion protein, dimeric protein or cross-linking protein and enrich the interleukin-1 receptor antagonistic protein within and around the pancreatic islet, more effectively exerting actions such as anti-inflammation, etc.

The GIP receptor binding polypeptide is linked to the interleukin-1 receptor antagonistic protein in various linkages through an alternative linking group (or spacer group).

(1) The GIP receptor binding polypeptide—linking group or spacer group—the interleukin-1 receptor antagonistic protein In one embodiment, the GIP receptor binding polypeptide and the interleukin-1 receptor antagonistic protein form a single chain compound via a linking group, for which the structure is (from left to right corresponding to the amino acid sequence from N-terminus to C-terminus):

GIP receptor binding polypeptide—linking group (or spacer group)-interleukin-1 receptor antagonistic protein; or interleukin-1 receptor antagonistic protein-linking group (or spacer group)-GIP-1 receptor binding polypeptide.

In one embodiment, the sequence of the fusion protein is (SEQ ID NO: 443)
$U_L$- $(X_{GI1}X_{GI2}X_{GI3}GT)_{t0}X_{GI6}X_{GI7}SDX_{GI10}SX_{GI12}X_{GI13}X_{GI14}DX_{GI16}X_{GI17}$
$X_{GI18}QX_{GI20}X_{GI21}FX_{GI23}X_{GI24}WLX_{GI27}X_{GI28}X_{GI29}X_{GI30}X_{GI31}X_{GI32}X_{GI33}$
$X_{GI34}X_{GI35}X_{GI36}X_{GI37}X_{GI38}X_{GI39}X_{GI40}X_{GI41}X_{GI42}X_{GI43}$-$L_j$-$X_{IL0}$RPSGRK
SSKNIQAFRIWDVNQKTFYLRNNQLVAGYLQGPNVNLEEKIDVVPIEP
HALFLGIHGGKNIX$_{IL66}$LSX$_{IL69}$VKSGDETRLQLEAVX$_{IL84}$ITDLSENR
KQDKRFAFIRSDSGPTTSFESAAX$_{IL116}$PGWFLX$_{IL122}$TAMEADQPVSLT
NMPDEGVMVTKFYFQEDE;
or (SEQ ID NO: 444)
$U_L$-$(X_{GI1}X_{GI2}X_{GI3}GT)_{t0}X_{GI6}$ISDX$_{GI10}$SX$_{GI12}$AMDX$_{GI16}$IHQQDFVNWL
X$_{GI27}$X$_{GI28}$QX$_{GI30}$(GX$_{GI32}$X$_{GI33}$NDWX$_{GI37}$HNITQ)$_{t1}$(PSSGAPPPS)$_{t2}$-
(GGGGS)$_m$-X$_L$-(GGGGS)$_n$-RPSGRKSSKMQAFRIWDVNQKTFYLRNN
QLVAGYLQGPNVNLEEKIDVVPIEPHALFLGIHGGKNICLSCVKSGDE
TRLQLEAVX$_{IL84}$ITDLSENRKQDKRFAFIRSDSGPTTSFESAAX$_{IL116}$P
GWFLCTAMEADQPVSLTNMPDEGVMVTKFYFQE YSIAMDKIHQQDFVNWLLAQK(GKKNDWKHNITQ)$_{n1}$(PSSGAPPP
S)$_{n2}$-(GGGGS)$_m$-RPSGRKSSKMQAFRIWDVNQKTFYLRNNQLVAGYLQ
GPNVNLEEKIDVVPIEPHALFLGIHGGKMCLSCVKSGDETRLQLEAVNIT
DLSENRKQDKRFAFIRSDSGPTTSFESAACPGWFLCTAMEADQPVSLTNM
PDEGVMVTKFYFQEDE-(GGGGS)$_n$-DAHKSEVAHRFKDLGEENFKALVL
IAFAQYLQQCPFEDHVKLVNEVTEFAKTCVADESAENCDKSLHTLFGDKL
CTVATLRETYGEMADCCAKQEPERNECFLQHKDDNPNLPRLVRPEVDVMC
TAFHDNEETFLKKYLYEIARRHPYFYAPELLFFAKRYKAAFTECCQAADK
AACLLPKLDELRDEGKASSAKQRLKCASLQKFGERAFKAWAVARLSQRFP
KAEFAEVSKLVTDLTKVHTECCHGDLLECADDRADLAKYICENQDSISSK
LKECCEKPLLEKSHCIAEVENDEMPADLPSLAADFVESKDVCKNYAEAKD
VFLGMFLYEYARRHPDYSVVLLLRLAKTYETTLEKCCAAADPHECYAKVF
DEFKPLVEEPQNLIKQNCELFEQLGEYKFQNALLVRYTKKVPQVSTPTLV
EVSRNLGKVGSKCCKHPEAKRMPCAEDYLSVVLNQLCVLHEKTPVSDRVT
KCCTESLVNRRPCFSALEVDETYVPKEFNAETFTFHADICTLSEKERQIK
KQTALVELVKHKPKATKEQLKAVMDDFAAFVEKCCKADDKETCFAEEGKK
LVAASQAALGL;

In one embodiment, the sequence of the fusion protein comprising the human albumin is:

(SEQ ID NO: 450)
(X$_{GI1}$X$_{GI2}$X$_{GI3}$GT)$_{t0}$X$_{GI6}$ISDYSIAMDKIHQQDFVNWLLAQK(GKK
NDWKHNITQ)$_{t1}$(PSSGAPPPS)$_{t2}$(X$_{GI1}$X$_{GI2}$X$_{GI3}$GT)$_{t0}$X$_{GI6}$ISDY
SIAMDKIHQQDFVNWLLAQK(GKKNDWKHNITQ)$_{t1}$(PSSGAPPP
S)$_{t2}$-(GGGGS)$_m$-DAHKSEVAHRFKDLGEENFKALVLIAFAQYLQ
QCPFEDHVKLVNEVTEFAKTCVADESAENCDKSLHTLFGDKLCTV
ATLRETYGEMADCCAKQEPERNECFLQHKDDNPNLPRLVRPEVDV
MCTAFHDNEETFLKKYLYEIARRHPYFYAPELLFFAKRYKAAFTE
CCQAADKAACLLPKLDELRDEGKASSAKQRLKCASLQKFGERAFK
AWAVARLSQRFPKAEFAEVSKLVTDLTKVHTECCHGDLLECADDR
ADLAKYICENQDSISSKLKECCEKPLLEKSHCIAEVENDEMPADL
PSLAADFVESKDVCKNYAEAKDVFLGMFLYEYARRHPDYSVVLLL
RLAKTYETTLEKCCAAADPHECYAKVFDEFKPLVEEPQNLIKQNC
ELFEQLGEYKFQNALLVRYTKKVPQVSTPTLVEVSRNLGKVGSKC
CKHPEAKRMPCAEDYLSVVLNQLCVLHEKTPVSDRVTKCCTESLV
NRRPCFSALEVDETYVPKEFNAETFTFHADICTLSEKERQIKKQT
ALVELVKHKPKATKEQLKAVMDDFAAFVEKCCKADDKETCFAEEG
KKLVAASQAALGL-(GGGGS)$_n$-RPSGRKSSKMQAFRIWDVNQKT
FYLRNNQLVAGYLQGPNVNLEEKIDVVPIEPHALFLGIHGGKMCL
SCVKSGDETRLQLEAVNITDLSENRKQDKRFAFIRSDSGPTTSPE
SAACPGWFLCTAMEADQPVSLTNMPDEGVMVTKFYFQEDE;

wherein m and n are each 0, 1, 2, 3, 4, 5, or 6 and other variables are defined as herein.

In one embodiment, the sequence of the fusion protein comprising IgG1 Fc is:

(SEQ ID NO: 451)
(X$_{GI1}$X$_{GI2}$X$_{GI3}$GT)$_{t0}$X$_{GI6}$ISDYSIAMDKIHQQDFVNWLLAQK(GKK
NDWKHNITQ)$_{t1}$(PSSGAPPPS)$_{t2}$-(GGGGS)$_m$-RPSGRKSSKMQA
FRIWDVNQKTFYLRNNQLVAGYLQGPNVNLEEKIDVVPIEPHALF
LGIHGGKMCLSCVKSGDETRLQLEAVNITDLSENRKQDKRFAFIR
SDSGPTTSFESAACPGWFLCTAMEADQPVSLTNMPDEGVMVTKFY
FQEDE-(GGGGS)$_n$-AEPKSCDKTHTCPPCPAPELLGGPSVFLFP
PKPKDTLMISRTPEVTCVVVDVSHEDPEVKFNWYVDGVEVHNAKT
KPREEQYNSTYRVVSVLTVLHQDWLNGKEYKCKVSNKALPAPIEK
TISKAKGQPREPQVYTLPPSREEMTKNQVSLTCLVKGFYPSDIAV
EWESNGQPENNYKTTPPVLDSDGSFFLYSKLTVDKSRWQQGNVFS
CSVMHEALHNHYTQKSLSLSPGK, wherein m and n are each 0, 1, 2, 3, 4, 5, or 6 and other variables are defined as herein.

In one embodiment, the sequence of the fusion protein comprising IgG1 Fc is:

(SEQ ID NO: 452)
(X$_{GI1}$X$_{GI2}$X$_{GI3}$GT)$_{t0}$X$_{GI6}$ISDYSIAMDKIHQQDFVNWLLAQK(GKK
NDWKHNITQ)$_{t1}$(PSSGAPPPS)$_{t2}$-(GGGGS)$_m$-AEPKSCDKTHTC
PPCPAPELLGGPSVFLFPPKPKDTLMISRTPEVTCVVVDVSHEDP
EVKFNWYVDGVEVHNAKTKPREEQYNSTYRVVSVLTVLHQDWLNG
KEYKCKVSNKALPAPIEKTISKAKGQPREPQVYTLPPSREEMTKN
QVSLTCLVKGFYPSDIAVEWESNGQPENNYKTTPPVLDSDGSFFL
YSKLTVDKSRWQQGNVFSCSVMHEALHNHYTQKSLSLSPGK-(GG
GGS)$_n$-RPSGRKSSKMQAFRIWDVNQKTFYLRNNQLVAGYLQGPN
VNLEEKIDVVPIEPHALFLGIHGGKMCLSCVKSGDETRLQLEAVN
ITDLSENRKQDKRFAFIRSDSGPTTSFESAACPGWFLCTAMEADQ
PVSLTNMPDEGVMVTKFYFQEDE;

wherein m and n are each 0, 1, 2, 3, 4, 5, or 6 and other variables are defined as herein.

All of the fusion proteins comprising IgG1 Fc are dimeric proteins connected by an interchain disulfide bond formed between the cysteines of the Fc portions of the two monomeric proteins.

In one embodiment, the sequence of the fusion protein comprising IgG4 Fc and the interleukin-1 receptor antagonistic protein is (SEQ ID NO: 453)
(X$_{GI1}$X$_{GI2}$X$_{GI3}$GT)$_{t0}$X$_{GI6}$ISDYSIAMDKIHQQDFVNWLLAQK(GKK
NDWKHNITQ)$_{t1}$(PSSGAPPPS)$_{t2}$-(GGGGS)$_m$-RPSGRKSSKMQA
FRIWDVNQKTFYLRNNQLVAGYLQGPNVNLEEKIDVVPIEPHALF
LGIHGGKMCLSCVKSGDETRLQLEAVNITDLSENRKQDKRFAFIR
SDSGPTTSFESAAX$_{IL116}$PGWFLCTAMEADQPVSLTNMPDEGVMVT KFYFQEDE-(GGGGS)$_n$-AESKYGPP$\underline{C}$PP$\underline{C}$PAPEAAGGPSVFLFPP
KPKDTLMISRTPEVTC$_a$VVVDVSQEDPEVQFNWYVDGVEVHNAKTK
PREEQFNSTYRVVSVLTVLHQDWLNGKEYKC$_a$KVSNKGLPSSIEKT
ISKAKGQPREPQVYTLPPSQEEMTKNQVSLTC$_b$LVKGFYPSDIAVE
WESNGQPENNYKTTPPVLDSDGSFFLYSRLTVDKSRWQEGNVFSC$_b$
SVMHEALHNHYTQKSLSLSLG, wherein m and n are each 0, 1, 2, 3, 4, 5, or 6 and other variables are defined as herein.

The dimeric protein is a homodimer consisting of two identical sequences mentioned above. Each cysteine C underlined and the cysteine at the corresponding position in the other monomer form an interchain disulfide bond; an intrachain disulfide bond is formed between the C$_a$s in each monomer; and an intrachain disulfide bond is formed between the C$_b$s in each monomer.

In this section, the fusion protein comprising the GIP receptor binding polypeptide and the interleukin-1 receptor antagonistic protein is selected from GI-1:
(SEQ ID NO: 155)
YSEGTFISDYSIAMDKIHQQDFVNWLLAQKGKKNDWKHNITQGGGGSRPSGRKSS
KMQAFRIWDVNQKTFYLRNNQLVAGYLQGPNVNLEEKIDVVPIEPHALFLGIHGGKMC
LSCVKSGDETRLQLEAVNITDLSENRKQDKRFAFIRSDSGPTTSFESAACPGWFLCTAME
ADQPVSLTNMPDEGVMVTKFYFQEDE;

GI-2:
(SEQ ID NO: 156)
Ac-YAEGTFISDYSIAMDKIHQQDFVNWLLAQKGKKNDWKHNITQRPSGRKSSKMQ
AFRIWDVNQKTFYLRNNQLVAGYLQGPNVNLEEKIDVVPIEPHALFLGIHGGKMCLSCV
KSGDETRLQLEAVNITDLSENRKQDKRFAFIRSDSGPTTSFESAACPGWFLCTAMEADQP
VSLTNMPDEGVMVTKFYFQEDE;

GI-3:
(SEQ ID NO: 157)
Ac-YAEGTFISDYSIAMDKIHQQDFVNWLLAQKGKKNDWKHNITQGGGGSRPSGRK
SSKMQAFRIWDVNQKTFYLRNNQLVAGYLQGPNVNLEEKIDVVPIEPHALFLGIHGGKM
CLSCVKSGDETRLQLEAVNITDLSENRKQDKRFAFIRSDSGPTTSPESAACPGWFLCTAM
EADQPVSLTNMPDEGVMVTKFYFQEDE;

GI-4:
(SEQ ID NO: 158)
Ac-YAEGTFISDYSIAMDKIHQQDFVNWLLAQKGKKNDWKHNITQGGGGSGGGGS
RPSGRKSSKMQAFRIWDVNQKTFYLRNNQLVAGYLQGPNVNLEEKIDVVPIEPHALFLGI
HGGKMCLSCVKSGDETRLQLEAVNITDLSENRKQDKRFAFIRSDSGPTTSFESAACPGWF
LCTAMEADQPVSLTNMPDEGVMVTKFYFQEDE;

GI-5:
(SEQ ID NO: 159)
Ac-YAEGTFISDYSIAMDKIHQQDFVNWLLAQKGKKNDWKHNITQGGGGSGGGGS
GGGGSRPSGRKSSKMQAFRIWDVNQKTFYLRNNQLVAGYLQGPNVNLEEKIDVVPIEPH
ALFLGIHGGKMCLSCVKSGDETRLQLEAVNITDLSENRKQDKRFAFIRSDSGPTTSFESAA
CPGWFLCTAMEADQPVSLTNMPDEGVMVTKFYFQEDE;

GI-6:
(SEQ ID NO: 160)
YAPGTFISDYSIAMDKIHQQDFVNWLLAQKGKKNDWKHNITQRPSGRKSSKMQAF
RIWDVNQKTFYLRNNQLVAGYLQGPNVNLEEKIDVVPIEPHALFLGIHGGKMCLSCVKS
GDETRLQLEAVNITDLSENRKQDKRFAFIRSDSGPTTSFESAACPGWFLCTAMEADQPVS
LTNMPDEGVMVTKFYFQEDE;

GI-7:
(SEQ ID NO: 161)
YAPGTFISDYSIAMDKIHQQDFVNWLLAQKGKKNDWKHNITQGGGGSRPSGRKSS
KMQAFRIWDVNQKTFYLRNNQLVAGYLQGPNVNLEEKIDVVPIEPHALFLGIHGGKMC

-continued

LSCVKSGDETRLQLEAVNITDLSENRKQDKRFAFIRSDSGPTTSFESAACPGWFLCTAME

ADQPVSLTNMPDEGVMVTKFYFQEDE;

GI-8:
(SEQ ID NO: 162)
YAPGTFISDYSIAMDKIHQQDFVNWLLAQKGKKNDWKHNITQGGGGSGGGGSRPS

GRKSSKMQAFRIWDVNQKTFYLRNNQLVAGYLQGPNVNLEEKIDVVPIEPHALFLGIHG

GKMCLSCVKSGDETRLQLEAVNITDLSENRKQDKRFAFIRSDSGPTTSFESAACPGWFLC

TAMEADQPVSLTNMPDEGVMVTKFYFQEDE;

GI-9:
(SEQ ID NO: 163)
YAPGTFISDYSIAMDKIHQQDFVNWLLAQKGKKNDWKHNITQGGGGSGGGGSGG

GGSRPSGRKSSKMQAFRIWDVNQKTFYLRNNQLVAGYLQGPNVNLEEKIDVVPIEPHAL

FLGIHGGKMCLSCVKSGDETRLQLEAVNITDLSENRKQDKRFAFIRSDSGPTTSPESAACP

GWFLCTAMEADQPVSLTNMPDEGVMVTKFYFQEDE;

GI-10:
(SEQ ID NO: 164)
ISDYSIAMDKIHQQDFVNWLLAQKPSSGAPPPSGGGGSGGGGSRPSGRKSSKMQAF

RIWDVNQKTFYLRNNQLVAGYLQGPNVNLEEKIDVVPIEPHALFLGIHGGKMCLSCVKS

GDETRLQLEAVNITDLSENRKQDKRFAFIRSDSGPTTSFESAACPGWFLCTAMEADQPVS

LTNMPDEGVMVTKFYFQEDE;

GI-11:
(SEQ ID NO: 165)
YGEGTFISDYSIAMDKIHQQDFVNWLLAQKPSSGAPPPSGGGGSGGGGSGGGGSRP

SGRKSSKMQAFRIWDVNQKTFYLRNNQLVAGYLQGPNVNLEEKIDVVPIEPHALFLGIH

GGKMCLSCVKSGDETRLQLEAVNITDLSENRKQDKRFAFIRSDSGPTTSFESAACPGWFL

CTAMEADQPVSLTNMPDEGVMVTKFYFQEDE;

GI-12:
(SEQ ID NO: 166)
YGEGTFISDYSIAMDKIHQQDFVNWLLAQKPSSGAPPPSGGGGSRPSGRKSSKMQA

FRIWDVNQKTFYLRNNQLVAGYLQGPNVNLEEKIDVVPIEPHALFLGIHGGKMCLSCVK

SGDETRLQLEAVNITDLSENRKQDKRFAFIRSDSGPTTSFESAACPGWFLCTAMEADQPV

SLTNMPDEGVMVTKFYFQEDE;

GI-13:
(SEQ ID NO: 167)
A-cYAEGTFISDYSIAMDKIHQQDFVNWLLAQKPSSGAPPPSGGGGSGGGGSGGGGS

RPSGRKSSKMQAFRIWDVNQKTFYLRNNQLVAGYLQGPNVNLEEKIDVVPIEPHALFLGI

HGGKMCLSCVKSGDETRLQLEAVNITDLSENRKQDKRFAFIRSDSGPTTSFESAACPGWF

LCTAMEADQPVSLTNMPDEGVMVTKFYFQEDE;

GI-14:
(SEQ ID NO: 168)
Ac-YAEGTFISDYSIAMDKIHQQDFVNWLLAQKPSSGAPPPSGGGGSGGGGSRPSGR

KSSKMQAFRIWDVNQKTFYLRNNQLVAGYLQGPNVNLEEKIDVVPIEPHALFLGIHGGK

MCLSCVKSGDETRLQLEAVNITDLSENRKQDKRFAFIRSDSGPTTSFESAACPGWFLCTA

MEADQPVSLTNMPDEGVMVTKFYFQEDE;

GI-15:
(SEQ ID NO: 169)
Ac-YAEGTFISDYSIAMDKIHQQDFVNWLLAQKPSSGAPPPSGGGGSRPSGRKSSKM

QAFRIWDVNQKTFYLRNNQLVAGYLQGPNVNLEEKIDVVPIEPHALFLGIHGGKMCLSC

-continued

VKSGDETRLQLEAVNITDLSENRKQDKRFAFIRSDSGPTTSFESAACPGWFLCTAMEADQ

PVSLTNMPDEGVMVTKFYFQEDE;

GI-16:
(SEQ ID NO: 170)
FISDYSIAMDKIHQQDFVNWLLAQKGGGGSGGGGSRPSGRKSSKMQAFRIWDVNQ

KTFYLRNNQLVAGYLQGPNVNLEEKIDVVPIEPHALFLGIHGGKMCLSCVKSGDETRLQ

LEAVNITDLSENRKQDKRFAFIRSDSGPTTSFESAACPGWFLCTAMEADQPVSLTNMPDE

GVMVTKFYFQEDE;

GI-17:
(SEQ ID NO: 171)
FISDYSIAMDKIHQQDFVNWLLAQKGGGGSRPSGRKSSKMQAFRIWDVNQKTFYL

RNNQLVAGYLQGPNVNLEEKIDVVPIEPHALFLGIHGGKMCLSCVKSGDETRLQLEAVNI

TDLSENRKQDKRFAFIRSDSGPTTSFESAACPGWFLCTAMEADQPVSLTNMPDEGVMVT

KFYFQEDE;

GI-18:
(SEQ ID NO: 172)
FISDYSIAMDKIHQQDFVNWLLAQKPSSGAPPPSGGGGSGGGGSRPSGRKSSKMQA

FRIWDVNQKTFYLRNNQLVAGYLQGPNVNLEEKIDVVPIEPHALFLGIHGGKMCLSCVK

SGDETRLQLEAVNITDLSENRKQDKRFAFIRSDSGPTTSFESAACPGWFLCTAMEADQPV

SLTNMPDEGVMVTKFYFQEDE;

GI-19:
(SEQ ID NO: 173)
YAPGTFISDYSIAMDKIHQQDFVNWLLAQKRPSGRKSSKMQAFRIWDVNQKTFYLR

NNQLVAGYLQGPNVNLEEKIDVVPIEPHALFLGIHGGKMCLSCVKSGDETRLQLEAVNIT

DLSENRKQDKRFAFIRSDSGPTTSFESAACPGWFLCTAMEADQPVSLTNMPDEGVMVTK

FYFQEDE;

GI-20:
(SEQ ID NO: 174)
YAPGTFISDYSIAMDKIHQQDFVNWLLAQKPSSGAPPPSGGGGSRPSGRKSSKMQA

FRIWDVNQKTFYLRNNQLVAGYLQGPNVNLEEKIDVVPIEPHALFLGIHGGKMCLSCVK

SGDETRLQLEAVNITDLSENRKQDKRFAFIRSDSGPTTSFESAACPGWFLCTAMEADQPV

SLTNMPDEGVMVTKFYFQEDE;

GI-21:
(SEQ ID NO: 175)
YAPGTFISDYSIAMDKIHQQDFVNWLLAQKPSSGAPPPSGGGGSGGGGSRPSGRKSS

KMQAFRIWDVNQKTFYLRNNQLVAGYLQGPNVNLEEKIDVVPIEPHALFLGIHGGKMC

LSCVKSGDETRLQLEAVNITDLSENRKQDKRFAFIRSDSGPTTSFESAACPGWFLCTAME

ADQPVSLTNMPDEGVMVTKFYFQEDE;

GI-22:
(SEQ ID NO: 176)
Ac-YAEGTFISDYSIAMDKIHQQDFVNWLLAQKGKKNDWKHNITQGGGGSRPSGRK

SSKMQAFRIWDVNQKTFYLRNNQLVAGYLQGPNVNLEEKIDVVPIEPHALFLGIHGGKM

CLSCVKSGDETRLQLEAVNITDLSENRKQDKRFAFIRSDSGPTTSFESAACPGWFLCTAM

EADQPVSLTNMPDEGVMVTKFYFQEDEGGGGSDAHKSEVAHRFKDLGEENFKALVLIA

FAQYLQQCPFEDHVKLVNEVTEFAKTCVADESAENCDKSLHTLFGDKLCTVATLRETYG

EMADCCAKQEPERNECFLQHKDDNPNLPRLVRPEVDVMCTAFHDNEETFLKKYLYEIA

RRHPYFYAPELLFFAKRYKAAFTECCQAADKAACLLPKLDELRDEGKASSAKQRLKCAS

LQKFGERAFKAWAVARLSQRFPKAEFAEVSKLVTDLTKVHTECCHGDLLECADDRADLA

-continued

KYICENQDSISSKLKECCEKPLLEKSHCIAEVENDEMPADLPSLAADFVESKDVCKNYAE

AKDVFLGMFLYEYARRHPDYSVVLLLRLAKTYETTLEKCCAAADPHECYAKVEDEFKPL

VEEPQNLIKQNCELFEQLGEYKFQNALLVRYTKKVPQVSTPTLVEVSRNLGKVGSKCCK

HPEAKRMPCAEDYLSVVLNQLCVLHEKTPVSDRVTKCCTESLVNRRPCFSALEVDETYV

PKEFNAETFTFHADICTLSEKERQIKKQTALVELVKHKPKATKEQLKAVMDDFAAFVEKC

CKADDKETCFAEEGKKLVAASQAALGL;

GI-23:

(SEQ ID NO: 177)
YAPGTFISDYSIAMDKIHQQDFVNWLLAQKGKKNDWKHNITQGGGGSRPSGRKSS

KMQAFRIWDVNQKTFYLRNNQLVAGYLQGPNVNLEEKIDVVPIEPHALFLGIHGGKMC

LSCVKSGDETRLQLEAVNITDLSENRKQDKRFAFIRSDSGPTTSFESAACPGWFLCTAME

ADQPVSLTNMPDEGVMVTKEYFQEDEGGGGSDAHKSEVAHRFKDLGEENFKALVLIAF

AQYLQQCPFEDHVKLVNEVTEFAKTCVADESAENCDKSLHTLFGDKLCTVATLRETYGE

MADCCAKQEPERNECFLQHKDDNPNLPRLVRPEVDVMCTAFHDNEETFLKKYLYEIAR

RHPYFYAPELLFFAKRYKAAFTECCQAADKAACLLPKLDELRDEGKASSAKQRLKCASL

QKFGERAFKAWAVARLSQRFPKAEFAEVSKLVTDLTKVHTECCHGDLLECADDRADLA

KYICENQDSISSKLKECCEKPLLEKSHCIAEVENDEMPADLPSLAADFVESKDVCKNYAE

AKDVFLGMFLYEYARRHPDYSVVLLLRLAKTYETTLEKCCAAADPHECYAKVEDEFKPL

VEEPQNLIKQNCELFEQLGEYKFQNALLVRYTKKVPQVSTPTLVEVSRNLGKVGSKCCK

HPEAKRMPCAEDYLSVVLNQLCVLHEKTPVSDRVTKCCTESLVNRRPCFSALEVDETYV

PKEFNAETFTFHADICTLSEKERQIKKQTALVELVKHKPKATKEQLKAVMDDFAAFVEKC

CKADDKETCFAEEGKKLVAASQAALGL;

(2) A dimeric protein/cross-linking protein of the interleukin-1 receptor antagonistic protein—the linking or spacer group—the GIP receptor binding polypeptide In such compounds, the linking group (or the spacer group) is linked at a non-terminal position of the interleukin-1 receptor antagonistic protein and of the GIP receptor binding polypeptide.

In one embodiment, the sequence of the fusion protein is (SEQ ID NO: 454)
$U_L$-$X_{IL0}$RPSGRKSSKMQAFRIWDVNQKTFYLRNNQLVAGYLQGPNV

NLEEKIDVVPIEPHALFLGIHGGKMCLSCVKSGDETRLQLEAVNI

TDLSENRKQDKRFAFIRSDSGPTTSFESAAC
(linking group- GLP receptor binding polypeptide)

PGWFLCTAMEADQPVSLTNMPDEGVMVTKFYFQEDE;

each of the variables is defined as herein.

In another embodiment, the sequence of the fusion protein is (SEQ ID NO: 455)
$U_L$-$X_{IL0}$RPSGRKSSKMQAFRIWDVNQKTFYLRNNQLVAGYLQGPNV NLEEKIDVVPIEPHALFLGIHGGKMCLSCVKSGDETRLQLEAVC
(linking group- GIP receptor binding polypeptide)

ITDLSENRKQDKRFAFIRSDSGPTTSFESAASPGWFLCTAMEADQP

VSLTNMPDEGVMVTKFYFQEDE;

each of the variables is defined as herein.

In one particular embodiment, the molecular structure of the linking group may be maleimide-PEG-maleimide or I—$CH_2$—CONH-PEG-NHCO—$CH_2$—I; in one particular embodiment, the molecular structure of the linking group may be maleimide-$(CH_2)_n$-maleimide or I—$CH_2$—CONH—$(CH_2)_n$—NHCO—$CH_2$—I, in which n may be an integer from 1 to 30; in one particular embodiment, the molecular structure of the linking group may be maleimide-PEG-NHS. The GIP receptor binding polypeptide may typically react with the linking group through the amino group on the side chain of a lysine or the mercapto group on the side chain of a cysteine.

In one embodiment, the sequence of the GIP receptor binding polypeptide may be (SEQ ID NO: 456)
$U_L$- $(X_{GI1}X_{GI2}X_{GI3}GT)_{t0}X_{GI6}$ISDX$_{GI10}$SX$_{GI12}$AMDX$_{GI16}$IHQQDFVNWL X$_{GI27}$X$_{GI28}$QX$_{GI30}$(GX$_{GI32}$X$_{GI33}$NDWX$_{GI37}$HNITQ)$_{t1}$(PSSGAPPPS)$_{t2}$, wherein each of the variables is defined as herein.

In one particular embodiment, the sequence of the GIP receptor binding polypeptide may be one of the following sequences:

(SEQ ID NO: 457)
X$_{GI1}$X$_{GI2}$X$_{GI3}$GTFISDYSIAMDKIHQQDFVNWLLAQKGKKNDWKHNI

TQC;

(SEQ ID NO: 458)
X$_{GI1}$X$_{GI2}$X$_{GI3}$GTFISDYSIAMDKIHQQDFVNWLLAQKGKKNDWCHNI
TQ;

(SEQ ID NO: 459)
X$_{GI1}$X$_{GI2}$X$_{GI3}$GTFISDYSIAMDKIHQQDFVNWLLAQKGKCNDWKHNI
TQ;

(SEQ ID NO: 460)
X$_{GI1}$X$_{GI2}$X$_{GI3}$GTFISDYSIAMDKIHQQDFVNWLLAQKGCKNDWKHNI
TQ;

(SEQ ID NO: 461)
X$_{GI1}$X$_{GI2}$X$_{GI3}$GTFISDYSIAMDKIHQQDFVNWLLAQCGKKNDWKHNI
TQ;

(SEQ ID NO: 462)
X$_{GI1}$X$_{GI2}$X$_{GI3}$GTFISDYSIAMDCIHQQDFVNWLLAQKGKKNDWKHNI
TQ;

(SEQ ID NO: 463)
X$_{GI1}$X$_{GI2}$X$_{GI3}$GTFISDYSCAMDKIHQQDFVNWLLAQKGKKNDWKHNI
TQ;

(SEQ ID NO: 464)
X$_{GI1}$X$_{GI2}$X$_{GI3}$GTFISDCSIAMDKIHQQDFVNWLLAQKGKKNDWKHNI
TQ;

(SEQ ID NO: 465)
X$_{GI1}$X$_{GI2}$X$_{GI3}$GTFISDYSIAMDKIHQQDFVNWLLAQKC;

(SEQ ID NO: 466)
X$_{GI1}$X$_{GI2}$X$_{GI3}$GTFISDYSIAMDCIHQQDFVNWLLAQK-NH$_2$;

(SEQ ID NO: 467)
X$_{GI1}$X$_{GI2}$X$_{GI3}$GTFISDYSIAMDKIHQQDFVNWLLAQKPSSGAPPPSC;

(SEQ ID NO: 468)
X$_{GI1}$X$_{GI2}$X$_{GI3}$GTFISDYSIAMDKIHQQDFVNWLLAQKPSSGAPPPC-
NH$_2$;

(SEQ ID NO: 469)
X$_{GI1}$X$_{GI2}$X$_{GI3}$GTFISDYSIAMDKIHQQDFVNWLLAQCPSSGAPPPS-
NH$_2$;

(SEQ ID NO: 470)
X$_{GI1}$X$_{GI2}$X$_{GI3}$GTFISDYSIAMDCIHQQDFVNWLLAQKPSSGAPPPS-
NH$_2$;

(SEQ ID NO: 471)
X$_{GI1}$X$_{GI2}$X$_{GI3}$GTFISDYSCAMDKIHQQDFVNWLLAQKPSSGAPPPS-
NH$_2$;

(SEQ ID NO: 472)
X$_{GI1}$X$_{GI2}$X$_{GI3}$GTFISDCSIAMDKIHQQDFVNWLLAQKPSSGAPPPS-
NH$_2$;

(SEQ ID NO: 473)
FISDYSIAMDKIHQQDFVNWLLAQKC;

(SEQ ID NO: 474)
FISDYSIAMDKIHQQDFVNWLLAQC-NH$_2$;

(SEQ ID NO: 475)
FISDYSIAMDCIHQQDFVNWLLAQK-NH$_2$;

(SEQ ID NO: 476)
ISDYSIAMDKIHQQDFVNWLLAQC-NH$_2$;
or (SEQ ID NO: 477)
ISDYSIAMDCIHQQDFVNWLLAQK-NH$_2$;

each of the variables is defined as herein;

The GIP-1 receptor binding polypeptide is linked to the interleukin-1 receptor antagonistic protein by reacting the mercapto group on the side chain of a cysteine with the maleimide or iodoacetyl on the linking group.

In one particular embodiment, the sequence of the GIP receptor binding polypeptide is one of the following sequences:

(SEQ ID NO: 478)
X$_{GI1}$X$_{GI2}$X$_{GI3}$GTFISDYSIAMDRIHQQDFVNWLLAQRGRRNDWRHNI
TQK;

(SEQ ID NO: 479)
X$_{GI1}$X$_{GI2}$X$_{GI3}$GTFISDYSIAMDRIHQQDFVNWLLAQRGRRNDWKHNI
TQ;

(SEQ ID NO: 480)
X$_{GI1}$X$_{GI2}$X$_{GI3}$GTFISDYSIAMDRIHQQDFVNWLLAQRGRKNDWRHNI
TQ;

(SEQ ID NO: 481)
X$_{GI1}$X$_{GI2}$X$_{GI3}$GTFISDYSIAMDRIHQQDFVNWLLAQRGKRNDWRHNI
TQ;

(SEQ ID NO: 482)
X$_{GI1}$X$_{GI2}$X$_{GI3}$GTFISDYSIAMDRIHQQDFVNWLLAQKGRRNDWRHNI
TQ;

(SEQ ID NO: 483)
X$_{GI1}$X$_{GI2}$X$_{GI3}$GTFISDYSIAMDKIHQQDFVNWLLAQRGRRNDWRHNI
TQ;

(SEQ ID NO: 484)
X$_{GI1}$X$_{GI2}$X$_{GI3}$GTFISDYSKAMDRIHQQDFVNWLLAQRGRRNDWRHNI
TQ;

(SEQ ID NO: 485)
X$_{GI1}$X$_{GI2}$X$_{GI3}$GTFISDKSIAMDRIHQQDFVNWLLAQRGRRNDWRHNI
TQ;

(SEQ ID NO: 486)
X$_{GI1}$X$_{GI2}$X$_{GI3}$GTFISDYSIAMDRIHQQDFVNWLLAQRPSSGAPPPSK;

(SEQ ID NO: 487)
X$_{GI1}$X$_{GI2}$X$_{GI3}$GTFISDYSIAMDRIHQQDFVNWLLAQRPSSGAPPPK-
NH$_2$;

(SEQ ID NO: 488)
X$_{GI1}$X$_{GI2}$X$_{GI3}$GTFISDYSIAMDRIHQQDFVNWLLAQKPSSGAPPPS-
NH$_2$;

(SEQ ID NO: 489)
X$_{GI1}$X$_{GI2}$X$_{GI3}$GTFISDYSIAMDKIHQQDFVNWLLAQRPSSGAPPPS-
NH$_2$;

```
                                                (SEQ ID NO: 490)
X_{GI1}X_{GI2}X_{GI3}GTFISDKSIAMDRIHQQDFVNWLLAQRPSSGAPPPS-

NH_2;

(SEQ ID NO: 491)
X_{GI1}X_{GI2}X_{GI3}GTFISDYSIAMDRIHQQDFVNWLLAQK-NH_2;

(SEQ ID NO: 492)
X_{GI1}X_{GI2}X_{GI3}GTFISDYSIAMDKIHQQDFVNWLLAQR-NH_2;

(SEQ ID NO: 493)
FISDYSIAMDRIHQQDFVNWLLAQK-NH_2;

(SEQ ID NO: 494)
FISDYSIAMDKIHQQDFVNWLLAQR-NH_2;

(SEQ ID NO: 495)
ISDYSIAMDRIHQQDFVNWLLAQK-NH_2;
or (SEQ ID NO: 496)
ISDYSIAMDKIHQQDFVNWLLAQR-NH_2;
``` each of the variables is defined as herein;

The GIP receptor binding polypeptide is reacted with the N-hydroxyl succinimidyl ester of the linking group through the amino group on the side chain of a lysine in the polypeptide, thus linking to the interleukin-1 receptor antagonistic protein.

In one embodiment, the sequence of the fusion protein is

```
                                                (SEQ ID NO: 497)
(GIP-1 receptor binding polypeptide-linking group)

C_{IL0}-X_{IL0}RPSGRKSSKMQAFRIWDVNQKTFYLRNNQL

VAGYLQGPNVNLEEKIDVVPIEPHALFLGIHGGKMCLSCVKSGD

ETRLQLEAVX_{IL84}ITDLSENRKQDKRFAFIRSDSGPTTSFESAA

X_{IL116}PGWFLCTAMEADQPVSLTNMPDEGVMVTKEYFQEDE,
```

In one embodiment, the linking group has an aldehyde group and is linked to the N-terminus of interleukin-1 receptor antagonistic protein through reductive amination; in another embodiment, $C_{IL0}$ cysteine is linked to the linking group via the mercapto group on the side chain, and then is linked to the GLP receptor binding polypeptide.

In one embodiment, the sequence of the fusion protein is

```
                                                (SEQ ID NO: 498)
U_L-X_{IL0}RPSGRKSSKMQAFRIWDVNQKTFYLRNNQLVAGYLQGP

NVNLEEKIDVVPIEPHALFLGIHGGKMCLSCVKSGDETRLQLEA

VX_{IL84}ITDLSENRKQDKRFAFIRSDSGPTTSFESAAX_{IL116}PGWF

LCTAMEADQPVSLTNMPDEGVMVTKFYFQEDEC_{IL153},
(linking group- GLP receptor binding
polypeptide)
``` each of the variables being defined as herein.

The GIP receptor binding polypeptide may typically react with the linking group through the amino or mercapto group on the side chain of an amino acid residue.

In one embodiment, the insulin receptor binding polypeptide is a modified conjugate.

The sequences of the dimeric protein/cross-linking protein of the GIP receptor binding polypeptide and the interleukin-1 receptor antagonistic protein are selected from:

GI-24:
```
                                                (SEQ ID NO: 178)
MRPSGRKSSKMQAFRIWDVNQKTFYLRNNQLVAGYLQGPNVNLE

EKIDVVPIEPHALFLGIHGGKMCLSCVKSGDETRLQLEAVC
(S-maleimide-PEG11-maleimide-S-GIP receptor
binding polypeptide)

ITDLSENRKQDKRFAFIRSDSGPTTSFESAASPGWFLCTAMEAD

QPVSLTNMPDEGVMVTKFYFQEDE;
(S is the sulphur atom on the side chain of a
cysteine residue)
``` wherein the GIP receptor binding polypeptide has the following sequence:

```
                                                (SEQ ID NO: 197)
Ac-YAEGTFISDYSIAMDKIHQQDFVNWLLAQKGKKNDWCHNITQ
``` and is linked to the interleukin-1 receptor binding protein by reacting the mercapto group on the side chain of a cysteine with the maleimide;

GI-25:
```
                                                (SEQ ID NO: 179)
RPSGRKSSKMQAFRIWDVNQKTFYLRNNQLVAGYLQGPNVNLEEKIDVV

PIEPHALFLGIHGGKMCLSCVKSGDETRLQLEAVNITDLSENRKQDKRF

AFIRSDSGPTTSFESAAC(S-maleimide-PEG40K-maleimide-S-

GIP receptor binding polypeptide)PGWFLCTAMEADQPVSLT

NMPDEGVMVTKFYFQEDE(S is the sulphur atom on the side chain of a cysteine residue);
``` wherein the GIP receptor binding polypeptide has the following sequence:

```
                                                (SEQ ID NO: 198)
Ac-YAEGTFISDYSIAMDKIHQQDFVNWLLAQKGKKNDWKHNITQC
``` and is linked to the interleukin-1 receptor binding protein by reacting the mercapto group on the side chain of a C-terminal cysteine with the maleimide;

GI-26:
```
                                                (SEQ ID NO: 180)
RPSGRKSSKMQAFRIWDVNQKTFYLRNNQLVAGYLQGPNVNLEEKIDVV

PIEPHALFLGIHGGKMCLSCVKSGDETRLQLEAVNITDLSENRKQDKRF

AFIRSDSGPTTSFESAAC(S-maleimide-PEG40K-maleimide-S-

GIP receptor binding polypeptide)PGWFLCTAMEADQPVSLT

NMPDEGVMVTKFYFQEDE(S is the sulphur atom on the side chain of a cysteine residue);
``` wherein the GIP receptor binding polypeptide has the following sequence:

```
                                                (SEQ ID NO: 199)
YAPGTFISDYSIAMDKIHQQDFVNWLLAQKGKKNDWKHNITQC
``` and is linked to the interleukin-1 receptor binding protein by reacting the mercapto group on the side chain of a C-terminal cysteine with the maleimide;

GI-27:
(SEQ ID NO: 181)
MRPSGRKSSKMQAFRIWDVNQKTFYLRNNQLVAGYLQGPNVNLEEKIDV

VPIEPHALFLGIHGGKMCLSCVKSGDETRLQLEAVNITDLSENRKQDKR

FAFIRSDSGPTTSFESAASPGWFLCTAMEADQPVSLTNMPDEGVMVTKF

YFQEDEC(S-maleimide-PEG11-maleimide-S-GIP receptor binding polypeptide)(S is the sulphur atom on the side chain of a cysteine residue);

wherein the sequence of the GIP receptor binding polypeptide is (SEQ ID NO: 200)
YAibEGTFISDYSIAMDKIHQQDFVNWLLAQC-NH₂;

GI-28:
(SEQ ID NO: 182)
C(S-maleimide-PEG11-maleimide-S-GIP receptor binding polypeptide)RPSGRKSSKMQAFRIWDVNQKTFYLRNNQ

LVAGYLQGPNVNLEEKIDVVPIEPHALFLGIHGGKMCLSCVKSGDETRL

QLEAVNITDLSENRKQDKRFAFIRSDSGPTTSFESAAC[S-CH₂-CONH- (CH₂CH₂O)₄-(CH₂)₂-NH-(Nᵅ-(HOOC(CH₂)₁₆CO)-γ-Glu)]PGWFL

CTAMEADQPVSLTNMPDEGVMVTKFYFQEDE(S is the sulphur atom on the side chain of a cysteine residue);

wherein the GIP receptor binding polypeptide has the sequence of (SEQ ID NO: 201)
YAibEGTFISDYSIAMDKIHQQDFVNWLLAQKPSSGAPPPSC and is linked to the interleukin-1 receptor binding protein by reacting the mercapto group on the side chain of a C-terminal cysteine with the maleimide;

GI-29:
(SEQ ID NO: 183)
MRPSGRKSSKMQAFRIWDVNQKTFYLRNNQLVAGYLQGPNVNLEEKIDV

VPIEPHALFLGIHGGKMCLSCVKSGDETRLQLEAVC(S-maleimide-

PEG40K-maleimide-S-GIP receptor binding polypeptide)ITDLSENRKQDKRFAFIRSDSGPTTSFESAASPGWFL CTAMEADQPVSLTN-MPDEGVMVTKFYFQEDE(S is the sulphur atom on the side chain of a cysteine residue);

wherein the GIP receptor binding polypeptide has the sequence of (SEQ ID NO: 202)
Ac-YAEGTFISDYSIAMDKIHQQDFVNWLLAQKPSSGAPPPC-NH₂ and is linked to the interleukin-1 receptor binding protein by reacting the mercapto group on the side chain of a C-terminal cysteine with the maleimide;

GI-30:
(SEQ ID NO: 184)
RPSGRKSSKMQAFRIWDVNQKTFYLRNNQLVAGYLQGPNVNLEEKIDVV

PIEPHALFLGIHGGKMCLSCVKSGDETRLQLEAVNITDLSENRKQDKRF

AFIRSDSGPTTSFESAAC(S-maleimide-PEG11-maleimide-S-

GIP receptor binding polypeptide)PGWFLCTAMEADQPVSL

TNMPDEGVMVTKFYFQEDE(S is the sulphur atom on the side chain of a cysteine residue)

wherein the GIP receptor binding polypeptide has the sequence of (SEQ ID NO: 203)
FISDYSIAMDKIHQQDFVNWLLAQKC-NH₂ and is linked to the interleukin-1 receptor binding protein by reacting the mercapto group on the side chain of a C-terminal cysteine with the maleimide.

Pharmaceutical Compositions and the Use

In a further aspect of the invention, a pharmaceutical composition comprising a therapeutically effective amount of a fusion protein or a fusion protein conjugate according to the present invention and a pharmaceutically acceptable carrier or additive, optionally other anti diabetic compounds, is provided for the treatment of type 1 diabetes, type 2 diabetes and other states that cause hyperglycemia. A fusion protein according to the present invention can be used for the manufacture of a pharmaceutical composition for use in the treatment of type 1 diabetes, type 2 diabetes and other states that cause hyperglycemia.

Injectable compositions of the fusion protein of the present invention can be prepared using the conventional techniques of the pharmaceutical industry which involve dissolving and mixing the suitable ingredients to give the final desired product. Thus, according to one procedure, a fusion protein according to the present invention is dissolved in an amount of water, of which the volume is somewhat less than the final volume of the composition to be prepared. An isotonic agent, a preservative and a buffer are added as required and the pH value of the solution is adjusted, if necessary, using an acid, e.g. hydrochloric acid, or a base, e.g. sodium hydroxide. Finally, the volume of the solution is adjusted with water to give the desired concentration.

In a further embodiment of the present invention, the buffer is selected from the group consisting of sodium acetate, sodium carbonate, citrate, glycylglycine, histidine, glycine, lysine, arginine, sodium dihydrogen phosphate, disodium hydrogen phosphate, sodium phosphate, and tris (hydroxymethyl)-aminomethane, bicine, tricine, malic acid, succinate, maleic acid, fumaric acid, tartaric acid, aspartic acid or mixtures thereof. Each one of these specific buffers constitutes an alternative embodiment of the invention.

In a further embodiment of the present invention, the preservative may be selected from the group consisting of phenol, o-cresol, m-cresol, p-cresol, methyl p-hydroxybenzoate, ethyl p-hydroxybenzoate, propyl p-hydroxybenzoate, butyl p-hydroxybenzoate, 2-phenoxyethanol, benzyl alcohol, chlorobutanol, thiomersal, bronopol, benzoic acid, imidurea, chlorohexidine, sodium dehydroacetate, chlorocresol, benzethonium chloride, chlorphenesine or mixtures thereof. The preservative is present in a concentration from 0.1 mg/ml to 20 mg/ml, preferably from 0.1 mg/ml to 5 mg/ml. In a further embodiment of the invention, the preservative is present in a concentration from 5 mg/ml to 10 mg/ml. Each one of these specific preservatives constitutes an alternative embodiment of the invention. The use of a preservative in pharmaceutical compositions is well-known to the skilled person. For convenience, reference is made to Remington: The Science and Practice of Pharmacy, 19th edition, 1995.

In a further embodiment of the present invention, the formulation further comprises an isotonic agent which may be selected from the group consisting of a salt (e.g. sodium chloride), a sugar or sugar alcohol, an amino acid, an alditol (e.g. glycerol, 1,2-propanediol, 1,3-propanediol, 1,3-butanediol), polyethyleneglycol (e.g. PEG400), or mixtures thereof. Any sugar such as mono-, di-, or polysaccharides, or water-soluble glucans, including for example fructose, glucose, mannose, sorbose, xylose, maltose, lactose, sucrose, trehalose, dextran, pullulan, dextrin, cyclodextrin, soluble starch, hydroxyethyl starch and carboxymethylcellulose-Na may be used.

In one embodiment, the sugar additive is sucrose. Sugar alcohol is defined as a C4-C8 hydrocarbon having at least one —OH group and includes, for example, mannitol, sorbitol, inositol, galactitol, dulcitol, xylitol, and arabitol. In one embodiment, the sugar alcohol additive is mannitol. The sugars or sugar alcohols mentioned above may be used individually or in combination. There is no fixed limit to the amount used, as long as the sugar or sugar alcohol is soluble in the liquid preparation and does not adversely effect the stabilizing effects achieved using the methods of the invention. In one embodiment, the sugar or sugar alcohol concentration is between 1 mg/ml and 150 mg/ml. In a further embodiment of the invention, the isotonic agent is present in a concentration from 1 mg/ml to 50 mg/ml. In a further embodiment of the invention, the isotonic agent is present in a concentration from 1 mg/ml to 7 mg/ml. In a further embodiment of the invention, the isotonic agent is present in a concentration from 8 mg/ml to 24 mg/ml. In a further embodiment of the invention, the isotonic agent is present in a concentration from 25 mg/ml to 50 mg/ml. Each one of these specific isotonic agents constitutes an alternative embodiment of the invention. The use of an isotonic agent in pharmaceutical compositions is well-known to the skilled person. For convenience, reference is made to Remington: The Science and Practice of Pharmacy, 19th edition, 1995.

Typical isotonic agents are sodium chloride, mannitol, dimethyl sulfoxide and glycerol, and typical preservatives are phenol, m-cresol, methyl p-hydroxybenzoate and benzyl alcohol. Examples of surfactants are sodium acetate, glycylglycine, HEPES (4-(2-hydroxyethyl)-1-piperazineethanesulfonic acid) and sodium phosphate.

EXAMPLES

Protective Groups

Acm acetamidomethy; Alloc or AOC allyloxycarbonyl; Bom, benzyloxymethyl; Br—Z, 2-bromobenzyloxycarbonyl; tBu, t-butyl; Bz, benzoyl; Bzl, benzyl; Boc:Butyloxy carbonyl; CHO formyl; cHx, cyclohexyl; Cbz or Z benzyloxycarbonyl; Cl—Z, 2-chlorobenzyloxycarbonyl; Fm, 9-fluorenylmethyl; Fmoc, 9-fluorenylmethoxycarbonyl; Mtt, 4-methyltrityl; Npys, 3-nitro-2-pyridinesulfenyl; Pmc, (2,2,5,7,8-pentamethylchroman-6-sulphonyl Tos, 4-toluenesulphonyl; Trt, triphenylmethyl; Xan, xanthyl.

Reagents and Solvents

ACN, acetonitrile; BOP, benzotriazol-1-yloxytris(dimethylamino) phosphonium hexafluorophosphate; DCC, N,N'-Dicyclohexylcarbodiimide; DCM, dichloromethane; DEPBT, 3-(Diethoxyphosphoryloxy)-1,2,3-benzotriazin-4 (3H)-one; DIC, N,N'-Diisopropylcarbodiimide; DIPEA (or DIEA), diisopropylethylamine; DMAP, 4-N,N-dimethylaminopyridine; DMF, dimethylformamide; DMSO, dimethyl sulfoxide; DTT, dithiothreitol; EDC or EDCI, 1-ethyl-3-(3-dimethylaminopropyl)carbodiimide. HCl; EtOAc, ethyl acetate; HBTU, O-(1H-benzotriazole-1-yl)-N,N,N',N-tetramethyluronium hexafluorophosphate; HOBT, 1-hydroxybenzotriazole; Cl-HOBT 6-chloro-1-hydroxybenzotriazole; NMM, N-Methylmorpholine; NMP, N-methylpyrrolidinone; Piperidine, Su, succinimide; TEA, triethylamine; TFA, trifluoroacetic acid; TFE 2,2,2-Trifluoroethanol; THF, tetrahydrofuran; TIS, triisopropylsilane.

Reagents used in the present invention are purchasable from an ordinary shop for chemical reagents or bio-reagent/preparations or reagents conventionally formulated in the field, unless otherwise specified. All of the experiments and the steps thereof can be performed by the person skilled in the art according to the disclosure in the present invention and the conventional techniques in the field.

Interleukin-1 Receptor Antagonistic Protein Open Reading Frame Sequence:

```
                                        (SEQ ID NO: 500)
ATGGAAATCTGCAGAGGCCTCCGCAGTCACCTAATCACTCTCCTCCTCT

TCCTGTTCCATTCAGAGACGATCTGCCGACCCTCTGGGAGAAAATCCAG

CAAGATGCAAGCCTTCAGAATCTGGGATGTTAACCAGAAGACCTTCTAT

CTGAGGAACAACCAACTAGTTGCTGGATACTTGCAAGGACCAAATGTCA

ATTTAGAAGAAAGATAGATGTGGTACCCATTGAGCCTCATGCTCTGTT

CTTGGGAATCCATGGAGGGAAGATGTGCCTGTCCTGTGTCAAGTCTGGT

GATGAGACCAGACTCCAGCTGGAGGCAGTTAACATCACTGACCTGAGCG

AGAACAGAAAGCAGGACAAGCGCTTCGCCTTCATCCGCTCAGACAGTGG

CCCCACCACCAGTTTTGAGTCTGCCGCCTGCCCCGGTTGGTTCCTCTGC

ACAGCGATGGAAGCTGACCAGCCCGTCAGCCTCACCAATATGCCTGACG

AAGGCGTCATGGTCACCAAATTCTACTTCCAGGAGGACGAGTAG.
```

IL-1ra Amino Acid Sequence:

```
                                        (SEQ ID NO: 501)
MEICRGLRSHLITLLLFLFHSETICRPSGRKSSKMQAFRIWDVNQKTFYL

RNNQLVAGYLQGPNVNLEEKIDVVPIEPHALFLGIHGGKMCLSCVKSGDE

TRLQLEAVNITDLSENRKQDKRFAFIRSDSGPTTSFESAACPGWFLCTAM

EADQPVSLTNMPDEGVMVTKFYFQEDE*.
```

1. Cloning of cDNA of Interleukin-1 Receptor Antagonistic Protein and Construction of Expression Vector 1.1 Designing the Primers Containing Restriction Enzyme Digestion Sites for Insertion of PCR Amplification Product of DNA The cDNA sequence of IL-1Ra was obtained from human hepatic tissue using RT-PCR technology. Firstly, we need to check the sequence of cDNA to be amplified to identify that these enzyme digestion sites are not in the cDNA, and design the appropriate primers to allow specific amplification of the 5' end of the cDNA. The cDNA sequence encoding complete or mature IL-1Ra was firstly amplified, and then ligated to pSUMO vector after digestion by restriction enzyme. Many pSUMO vectors are commercially available, such as the products of Lifesensors, Invitrogen, can be used for the proteins in the present invention.

Primer Design

```
Forward primer 1:
                                  (SEQ ID NO: 502)
(5' GGCGGTCTCTAGGT-ATGGAAATCTGCAGA-3')
``` for cloning the complete sequence of IL-1ra

```
Forward primer2:
                                  (SEQ ID NO: 503)
(5' GGCGGTCTCTAGGT-CGACCCTCTGGGAGA-3')
``` for cloning the mature peptide sequence of IL-1ra
In this sequence, GGTCTC is the recognition sequence of restriction enzyme BsaI.

```
Reverse Primer
                                  (SEQ ID NO: 504)
5'-GGCGGATCCTTA CTACTCGTCCTCCTG-3'
```

In this sequence, GGATCC is the recognition sequence of restriction enzyme BamHI.

1.2 Reverse Transcription-Polymerase Chain Reaction (RT-PCR)
Firstly, human IL-1Ra cDNA was obtained by reverse transcription-polymerase chain reaction techniques.
reverse transcription:

| | |
|---|---|
| hepatic tissue RNA(1 µg/µl) | 2 µl |
| oligonucleotide primer | 1 µl |
| water | 2 µl |
| | 5 µl |

Mixed, and denatured at 70° C. for 5 minutes, and then placed on ice for 5 minutes.
10× reverse transcription buffer 2 µl

| | |
|---|---|
| MgCl$_2$(25 mM) | 4.4 µl |
| dNTPs(10 mM) | 1 µl |
| water | 6.1 µl |
| RNase inhibitor | 0.5 µl |
| Reverse transcriptase | 1 µl |
| | 15 µl |

The above two solutions were mixed, and placed in the PCR machine for reverse transcription reaction (25° C. 5 minutes, 42° C. 1 hour, 70° C. 15 minutes) PCR reaction system:

| | |
|---|---|
| 10X buffer | 2.5 µl |
| cDNA Template | 0.5 µl |
| Forward primer 2 (25 µM) | 2 µl |
| Reverse primer (25 µM) | 2 µl |
| Taq DNA polymerase | 1 µl |
| dNTPs(10 mM) | 0.5 µl |
| Nuclease free water | 16.5 µl |
| | 25 µl |

PCR Reaction Program:

| | | |
|---|---|---|
| Step1 94° C. | 5 min | |
| Step2 94° C. | 30 sec | |
| Step3 54° C. | 30 sec | 30 cycles |
| Step4 72° C. | 1 min | |
| Step5 72° C. | 5 min | |

1.3 Purification of PCR Product
Qiagen DNA gel extraction kit was used to extract DNA from agarose gels
1. Electrophorese the PCR product through the 1% agarose gel. Locate the PCR product band which is expected to be 0.5 kb in the gel using a long wavelength UV lamp.
2. Excise the gel slice containing the PCR product with clean a blade.
3. Weight the gel slice in a tube. Add 3 volume of buffer QX1 to 1 volume of gel slice.
4. Add 20 µl of QIAEX II to the sample.
5. Incubate at 50° C. for 10 min to solubilize the gel and bind DNA.
6. Centrifuge the sample for 30 sec and carefully remove the supernatant.
7. Wash the precipitate with the buffer QX1.
8. Wash the precipitate twice with the buffer PE.
9. Air-dry the precipitate for 15 min.
10. Add 20 µl of H$_2$O and elute the DNA by vortex. Place at room temperature for 5 min.
11. Centrifuge for 30 sec. Carefully transfer the supernatant into a clean tube. (The supernatant contains the purified DNA).
1.4 Restriction Enzyme Digestion:
BsaI and BamHI was used as restriction enzymes.
10× digestion buffer 2.5 µl
BsaI (10 unit/µl) 1.5 µl
Purified PCR product 21 µl
25 µl
Digested at 50° C. for 1 hour. Add 0.5 µl 10× digestion buffer (NEB2), 1.5 µl BamHI (10 unit/µl), and 10×BSA (NEB) 3 µl and then digested at 37° C. for another 1 hour.
1.5 Purification of Digested DNA Product
Montage DNA gel extraction kit #LSKG ELO 50 (Millipore) was used.
1.6 Ligation of IL-1Ra cDNA and pSUMO Vector (See FIGS. 1A and 1B)
1. Combine 50 µg of vector (1 µl pSUMO vector diluted with 4 µl nuclease free water to make a final concentration of 50 µg/µl) with cDNA to be inserted to a total volume of 10 µl (1 µl diluted vector plus 9 µl digested PCR product).
2. Add 10 µl of 2× Ligation Buffer and Mix.
3. Add 1 µl of T4 DNA Ligase, mixed and centrifuged.
4. Placed at room temperature for 1 hour.
5. Move to transformation.
1.7 Transformation of *E. coli* DH5α
1. Thaw DH5α cells on ice.
2. 30 µl DH5α cell suspension was used per transformation.
3. 2 µl of ligated product was mixed with the 30 µl DH5α cell suspension.
4. Place the cells on ice for 45 min.
5. Heat shock at 42° C. for 90 seconds in a water bath.
6. Place cells on ice for 5 minutes.
7. Add 250 µl SOC culture medium, and then shake the cells at 37° C./200 rpm for 1 hr.
8. Plate 100 µl of cells suspension on LB agar plate with 100 µg/ml ampicillin and incubate at 37° C. overnight.
1.8 Plasmid DNA Analysis
1. Pick 1-10 colonies, and PCR was conducted with a T7 forward primer and a reverse primer which is used to amplify specific IL-1ra gene to identify the positive colonies.

2. incubate 3 to 5 positive colonies into 5 ml broth medium with μg/ml ampicillin.
3. Shake at 37° C./250 rpm overnight.
4. Extract plasmid DNA.

1.9 Sequencing of Plasmid DNA (See FIG. 2)
1. The extracted plasmid DNA was sequenced with a T7 forward primer and a pSUMO vector specific reverse primer.
2. After sequencing, the pSUMO expression plasmid carrying IL-1ra cDNA was stored at −80° C., and was ready to be transformed into the *E. coli* strain OrigamiB (DE3).

2. Expression of interleukin-1 receptor antagonistic proteinin *E. coli* Note: The following concentrations/volumes of reagents represent culture volume of 1 liter.

2.1 Transformation of *E. coli* origamiB (DE3)
1. Thaw 20 μl *E. coli* origamiB (DE3) cells on ice.
2. Add 1 plof pSUMO expression plasmid carrying IL-1ra cDNA to the competent cells, and stirred gently and mixed.
3. Tubes were placed on ice for 5 minutes.
4. Heat shock at 42° C. for 30 seconds in a water bath.
5. Place the cells on ice for 2 minutes.
6. Add 80 μl SOC medium.
7. Incubate cells at 37° C. for 1 hour.
8. Plate 100 μl cells suspension on LB/Ampicillin (100 μg/ml) agar plates and culture at 37° C. overnight.

2.2 Protein Expression
1. Medium preparation: prepare 1 liter of LB medium, preheat at 37° C. overnight, ampicillin was added before use to make a final concentration of 100 μg/ml.
2. Seed culture: pick a good colony of transformed origamiB (DE3) and incubate into a 50 ml flask containing 12.5 ml of LB medium with 100 μg/ml ampicillin, and then culture at 37° C. overnight.
3. Preparative culture: incubate 4 ml of overnight cultured origamiB (DE3) cells into 1 liter of preheated LB medium with 100 μg/ml ampicillin.

Note: strains stored in glycerol should be made and stored at −80° C. (400 μl of culture and 600 μl of sterile glycerol). Culture samples were collected before and after IPTG induction, and analyze the protein expression by SDS-PAGE.

4. IPTG induction: after the OD600 reaches 0.4 (takes about 3 hr), induce protein expression by adding 48 mg IPTG (isopropyl-beta-D-thiogalactopyranoside) (final concentration of IPTG is 0.2 mM) and culture for additional 3 hours.
5. Cell collection: collect cells with centrifugation at 5500 rpm for 10 minutes.

2.3 Extraction: Cell Lysis
1. Re-suspend the cell with 15 ml of Bugbuster protein extraction reagent.
2. Add 15 μl Benzonase nuclease and 100 μl of 100 mg/ml PMSF (protease inhibitor) for cell lysis.
3. Incubate 15 min at room temperature with rotation.
4. Load 2 ml cell lysate into 2 ml microcentrifuge tubes.
5. Centrifuge at 14,000 rpm for 30 minutes at 4° C. in a microcentrifuge.
6. The precipitate (inclusion bodies) is solubilized in 8 ml of 50 mM HEPES-NaOH pH7.5, 6M guanidine HCl, 25 mM DTT and left for 1 h at 4° C.
7. Insoluble material was removed by centrifugation at 14,000 rpm for 30 min at 4° C.
8. Store the supernatants (contains solubilized protein) at −20° C.

2.4 His-Tag Purification
TALON columns (Clontech, #635601, 2 ml, 2-4 mg binding capacity per column. Stored at 4° C.) was used.
1. Before use, flick the column to make the resin fall to the bottom.
2. Place column in the 2 ml microcentrifuge tube, remove the top cap and centrifuge at 1000 rpm for 2 minutes.
3. Add 1 ml equilibration buffer (50 mM sodium phosphate, 6M guanidineHCl, 500 mM NaCl), and fully suspend the resin.
4. Centrifuge the column at 1000 rpm for 2 minutes.
5. Repeat the equilibrating steps.
6. Add 1.5 ml of concentrated sample to each column.
7. Flick the column to suspend resin fully, and then rotate the column for 5 minutes at 4° C.
8. Centrifuge at 1000 rpm for 2 minutes.
9. Wash the column with 1 ml washing buffer (same as equilibration buffer), fully suspend the resin and rotate the column for 5 min.
10. Centrifuge at 1000 rpm for 2 minutes.
11. Repeat the washing steps.
12. Elute the tagged protein with 700 μl elution buffer (50 mM sodium phosphate, 6M guanidineHCl, 500 mM NaCl, 150 nM imidazole) at 1000 rpm for 2 minutes.
13. Collect the eluate.

2.5 Protein Refolding
1. Prepare the refolding solution (50 mM HEPES pH7.5, 0.2M NaCl, 1 mM DTT, 1M NDSB201). NDSB201 is 3-(1-pyridine)-1-propene sulfonate.
2. Mix purified protein and refolding solution at a 1:5 ratio, and vortex vigorously immediately for 30 seconds.
3. Rotate the sample for 1 hr at 4° C.
4. Concentrate and dialyse the sample.

2.6 Sample Concentration
Column: Amicon Ultra-430 kDa cut-off centrifugal filter (Millipore, #UFC803024)
1. 4 ml sample was loaded on the upper portion of the Amicon centrifuge tubes.
2. Centrifuge at 3,000 rpm for 10 minutes at 4° C. or until the volume on the upper fraction reaches 1 ml.
3. Collect the concentrated sample for dialysis.

2.7 Dialysis
Equipment: D-tube Dialyzer Maxi, MWCO 6-8 (Novagen, #71509-3)
1. Equilibrate the Dialyzer membrane by filling the dialyzer with 2 ml deionized water and place at room temperature for 5 minutes.
2. Discard the water, and load 2 ml of sample into each dialyzer.
3. Close the dialyzer and put into the floating holder.
4. Dialyze sample with 1 liter 50 mM Tris-HCl, 500 mM NaCl buffer overnight at 4° C. to remove guanidine-HCl.
5. Collect the dialyzed sample.
6. Check the protein on SDS-PAGE before His-Tag removal step.

2.8 SUMO tag removal
1. Add 5 μl SUMO protease into 500 μl of dialyzed IL-1ra, and incubate at 37° C. for 1 hour.
2. Remove the His-Tag using a Talon column.
3. Load 100 μl of resin into an empty 1.5 ml microcentrifuge tube.
4. Centrifuge at 3,000 rpm and remove the storing buffer.
5. Add 500 μl 50 mM Tris-HCl, 500 mM NaCl to suspend and equilibrate the resin.
6. Centrifuge at 3,000 rpm, and remove the equilibrating buffer.
7. Add 500 μl digested sample into centrifuge tubes containing equilibrated resin.
8. Mix the resin and protein, rotate for 5 minutes at 4° C.
9. Centrifuge at 3000 rpm and 4° C. to separate the resin, collect the supernatant containing cleaved, separated IL-1ra.
10. Analyze the sample by 15% SDS-PAGE.

Figure 4:
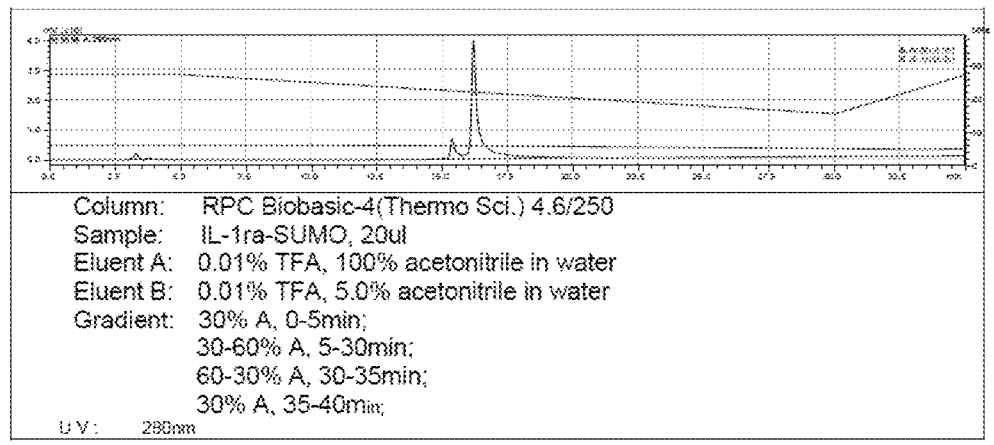
FIG. 4 is the purity of the G-20 samples analyzed with RP-HPLC at a special buffer gradient.
Figure 5:
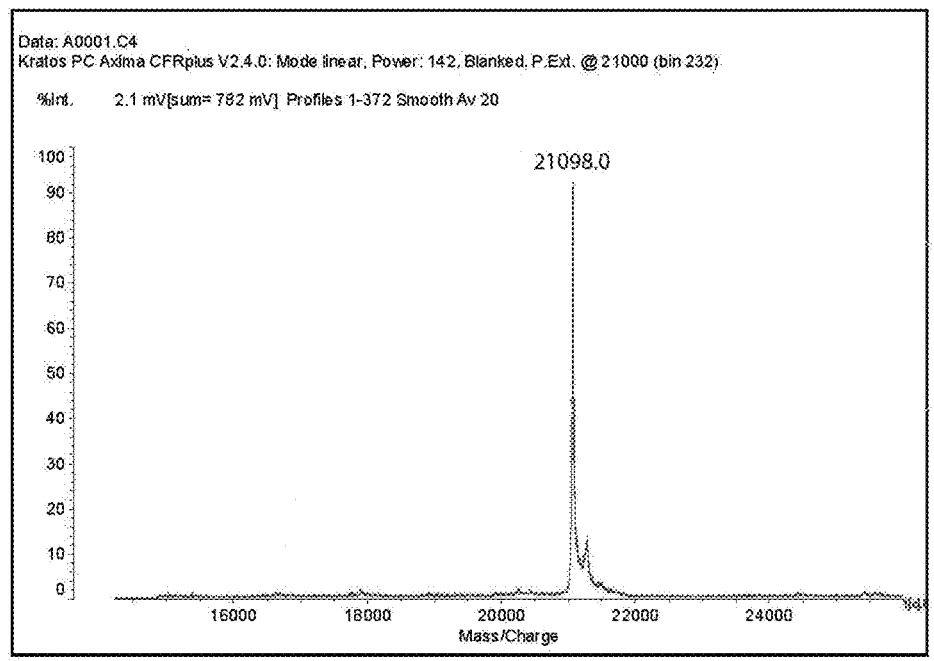
FIG. 5 is the mass spectrum for the fusion protein G-20.

11. The sample purity was analyzed byRP-HPLC, see FIG. 4, and purify the sample with RP-HPLC, if necessary.
12. The peptide sequence could be determined by mass spectrum and peptide mass fingerprinting, see FIGS. 5 and 6.

The cDNA sequence for the insulin receptor binding polypeptide-linking group-IL-1Ra (comprising two copies of the linking group)

(SEQ ID NO: 505)
TTTGTCAATCAGCACCTTTGTGGTTCTCACCTGGTGGAGGCTCTGTACC

TGGTGTGTGGGGAACGTGGTTTCTTCTACACACCCAAGACCGGCTCGGG

CTCGTCGTCGGCTGCTGCTCCCCAGACCGGCATTGTGGAGCAGTGCTGC

ACCAGCATCTGCTCCCTCTACCAACTGGAGAACTACTGCAACGGCGGCG

GCGGCTCGGGCGGCGGCGGCTCGCGACCCTCTGGGAGAAAATCCAGCAA

GATGCAAGCCTTCAGAATCTGGGATGTTAACCAGAAGACCTTCTATCTG

AGGAACAACCAACTAGTTGCTGGATACTTGCAAGGACCAAATGTCAATT

TAGAAGAAAGATAGATGTGGTACCCATTGAGCCTCATGCTCTGTTCTT

GGGAATCCATGGAGGGAAGATGTGCCTGTCCTGTGTCAAGTCTGGTGAT

GAGACCAGACTCCAGCTGGAGGCAGTTAACATCACTGACCTGAGCGAGA

ACAGAAAGCAGGACAAGCGCTTCGCCTTCATCCGCTCAGACAGTGGCCC

CACCACCAGTTTTGAGTCTGCCGCCTGCCCCGGTTGGTTCCTCTGCACA

GCGATGGAAGCTGACCAGCCCGTCAGCCTCACCAATATGCCTGACGAAG

GCGTCATGGTCACCAAATTCACTTCCAGGAGGACGAGTAG;

The amino acid sequence of the insulin receptor binding polypeptide-linking group-IL-1Ra (comprising two copies of the linking group) (IN-7)

(SEQ ID NO: 91)
FVNQHLCGSHLVEALYLVCGERGFFYTPKTGSGSSSAAAPQTGIVEQCC

TSICSLYQLENYCNGGGGSGGGGSRPSGRKSSKMQAFRIWDVNQKTFYL

RNNQLVAGYLQGPNVNLEEKIDVVPIEPHALFLGIHGGKNICLSCVKSG

DETRLQLEAVNITDLSENRKQDKRFAFIRSDSGPTTSFESAACPGWFLC

TAMEADQPVSLTNMPDEGVMVTKFYFQEDE;

The cDNA sequence for the Exendin-4-linking group-IL-1Ra (comprising two copies of the linking group)

(SEQ ID NO: 506)
CATGGTGAAGGAACATTTACCAGTGACTTGTCAAAACAGATGGAAGAGG

AGGCAGTGCGGTTATTTATTGAGTGGCTTAAGAACGGAGGACCAAGTAG

CGGGGCACCTCCGCCATCGGGCGGCGGCGGCTCGGGCGGCGGCGGCTCG

CGACCCTCTGGGAGAAAATCCAGCAAGATGCAAGCCTTCAGAATCTGGG

ATGTTAACCAGAAGACCTTCTATCTGAGGAACAACCAACTAGTTGCTGG

ATACTTGCAAGGACCAAATGTCAATTTAGAAGAAAGATAGATGTGGTA

CCCATTGAGCCTCATGCTCTGTTCTTGGGAATCCATGGAGGGAAGATGT

GCCTGTCCTGTGTCAAGTCTGGTGATGAGACCAGACTCCAGCTGGAGGC

AGTTAACATCACTGACCTGAGCGAGAACAGAAAGCAGGACAAGCGCTTC

GCCTTCATCCGCTCAGACAGTGGCCCCACCACCAGTTTTGAGTCTGCCG

CCTGCCCCGGTTGGTTCCTCTGCACAGCGATGGAAGCTGACCAGCCCGT

CAGCCTCACCAATATGCCTGACGAAGGCGTCATGGTCACCAAATTCTAC

TTCCAGGAGGACGAGTAG;

The amino acid sequence of the Exendin-4-linking group-IL-1Ra (comprising two copies of the linking group) (G-3)

(SEQ ID NO: 3)
HGEGTFTSDLSKQMEEEAVRLFIEWLKNGGPSSGAPPPSGGGGSGGGGS

RPSGRKSSKMQAFRIWDVNQKTFYLRNNQLVAGYLQGPNVNLEEKIDVV

PIEPHALFLGIHGGKMCLSCVKSGDETRLQLEAVNITDLSENRKQDKRF

AFIRSDSGPTTSFESAACPGWFLCTAMEADQPVSLTNMPDEGVMVTKFY

FQEDE;

The cDNA sequence for GLP-1 receptor binding polypeptide-linking group-IL-1Ra (comprising two copies of the linking group)

(SEQ ID NO: 507)
CATGGTGAAGGAACATTTACCAGTGACGTGTCGTCGTACCTCGAGGAGC

AGGCTGCTAAGGAGTTTATTGCTTGGCTCGTGAAGGGCCGAGGCGGCGG

CGGCTCGGGCGGCGGCGGCTCGCGACCCTCTGGGAGAAAATCCAGCAAG

ATGCAAGCCTTCAGAATCTGGGATGTTAACCAGAAGACCTTCTATCTGA

GGAACAACCAACTAGTTGCTGGATACTTGCAAGGACCAAATGTCAATTT

AGAAGAAAGATAGATGTGGTACCCATTGAGCCTCATGCTCTGTTCTTG

GGAATCCATGGAGGGAAGATGTGCCTGTCCTGTGTCAAGTCTGGTGATG

AGACCAGACTCCAGCTGGAGGCAGTTAACATCACTGACCTGAGCGAGAA

CAGAAAGCAGGACAAGCGCTTCGCCTTCATCCGCTCAGACAGTGGCCCC

ACCACCAGTTTTGAGTCTGCCGCCTGCCCCGGTTGGTTCCTCTGCACAG

CGATGGAAGCTGACCAGCCCGTCAGCCTCACCAATATGCCTGACGAAGG

CGTCATGGTCACCAAATTCTACTTCCAGGAGGACGAGTAG;

The amino acid sequence of the GLP-1 receptor binding polypeptide-linking group-IL-1Ra (comprising two copies of the linking group)

(SEQ ID NO: 20)
HGEGTFTSDVSSYLEEQAAKEFIAWLVKGRGGGGSGGGGSRPSGRKSSK

MQAFRIWDVNQKTFYLRNNQLVAGYLQGPNVNLEEKIDVVPIEPHALFL

GIHGGKMCLSCVKSGDETRLQLEAVNITDLSENRKQDKRFAFIRSDSGP

TTSFESAACPGWFLCTAMEADQPVSLTNMPDEGVMVTKFYFQEDE.

Construction of a Fusion Gene for GLP-1 Receptor Binding Polypeptide—Linking Group-IL-1Ra and Expression of the Fusion Protein The cDNA fragments encoding GLP-1 and IL-1Ra were amplified by PCR procedure, using specific primers for GLP-1 and IL-1Ra (P1, GLP-1 forward primer:

(SEQ ID NO: 508)
5'-GGCGGTCTCTAGGTCATGGTGAAGGAACATTTA-3';

P2, GLP-1 reverse primer:

(SEQ ID NO: 509)
5'-CAGAGGGTCGCGAGCCGCCGCCGCCCGAGCCGCCGCCGCCTCGG

CCCTTCACGA GCCA-3';

P3, IL-1Ra forward primer:

(SEQ ID NO: 510)
5'-GGCCGAGGCGGCGGCGGCTCGGGCGGCGGCGGCTCGCGACCCTCTG

GGAGAAAA-3';

P4, IL-1Ra reverse primer:

(SEQ ID NO: 511)
5'-GGCGGATCCCTACTCGTCCTCCTGGAAGTAGAATTT G-3' and the plasmids with GLP-1 and IL-1Ra genes as the templates. The restriction enzyme sites Bsa 1 and Bam HI were introduced respectively into the primers P1 and P4. The primers P2 and P3 have a complementary region of 46 base pairs in which a linking group encoding a decapeptide is contained. A fusion gene encoding GLP-1 and IL-1Ra was amplified by overlapping PCR using the primers P1 and P4 and the two above-mentioned PCR products as the templates. The fusion gene for GLP-1 and IL-1Ra were linked by two copies of the linking group GGGGS, an then the fusion gene for GLP-1 and IL-1Ra was digested with the restriction enzymes Bsa 1 and Bam HI and ligated into the vector pSUMO digested with the same enzymes, resulting in a recombinant expression plasmid comprising the fusion gene for GLP-1 and IL-1Ra. After the expression plasmid was verified by sequencing, the expression plasmid was transformed into *E. coli.* OrigamiB (DE3) to express the fusion protein of GLP-1 and IL-1Ra. The procedures for construction of the expression plasmid, transformation into the *E. coli.* OrigamiB and expression and purification of the fusion protein are all the same as those in clone and expression of the gene for interleukin-1 receptor antagonist.

The strategies for construction and expression of the fusion gene for the insulin receptor binding polypeptide-linking group-IL-1Ra, the GIP receptor binding polypeptide-linking group-IL-1Ra and Exendin-4-linking group-IL-1Ra are the same as those in construction and expression of the fusion gene for the GLP-1 receptor binding polypeptide-linking group-IL-1Ra.

The primers in the invention were synthesized by using an oligonucleotide synthesizer. The GLP-1 receptor binding polypeptide, the GIP receptor binding polypeptide, the Exendin-4 analogue, the insulin receptor binding polypeptide, and the interleukin-1 receptor antagonistic protein, even the cDNA for the full length fusion protein of the present invention, can all be synthesized chemically. Many biotechnology companies domestic and abroad provide service for synthesis of a full-length gene. The gene sequences of the cDNAs for the native human albumin and IL-1Ra can be obtained with RT-PCR from hepatic tissues of human. In addition, the cDNAs for the human albumin and IL-1Ra can be purchased from many commercial companies, such as Origene, Sino Biological Inc., etc. Methods of obtaining and expressing the cDNA for human albumin can further be referred to the literature (Lawn, et al., "The sequence of human serum albumin cDNA and its expression in *E. coli.*" Nucleic Acids Res. 1981, 9 (22): 6103-6114). Methods of obtaining and expressing the cDNA for IL-1Ra can be referred to the literature (Eisenberg, et al., "Primary structure and functional expression from complementary DNA of a human interleukin-1 receptor antagonist." Nature, 1990, 343: 341-346).

The cDNA sequence for Human albumin (SEQ ID NO: 512)
GATGCAC ACAAGAGTGA GGTTGCTCAT CGGTTTAAAG

ATTTGGGAGA AGAAAATTTC AAAGCCTTGGTGTTGATTGC

CTTTGCTCAG TATCTTCAGC AGTGTCCATT TGAAGATCAT

GTAAAATTAGTGAATGAAGT AACTGAATTT GCAAAAACAT

GTGTTGCTGA TGAGTCAGCT GAAAATTGTGACAAATCACT

TCATACCCTT TTTGGAGACA AATTATGCAC AGTTGCAACT

CTTCGTGAAACCTATGGTGA AATGGCTGAC TGCTGTGCAA

AACAAGAACC TGAGAGAAAT GAATGCTTCTTGCAACACAA

AGATGACAAC CCAAACCTCC CCCGATTGGT GAGACCAGAG

GTTGATGTGATGTGCACTGC TTTTCATGAC AATGAAGAGA

CATTTTTGAA AAAATACTTA TATGAAATTGCCAGAAGACA

TCCTTACTTT TATGCCCCGG AACTCCTTTT CTTTGCTAAA

AGGTATAAAGCTGCTTTTAC AGAATGTTGC CAAGCTGCTG

ATAAAGCTGC CTGCCTGTTG CCAAAGCTCGATGAACTTCG

GGATGAAGGG AAGGCTTCGT CTGCCAAACA GAGACTCAAG

TGTGCCAGTCTCCAAAAATT TGGAGAAAGA GCTTTCAAAG

CATGGGCAGT AGCTCGCCTG AGCCAGAGATTTCCCAAAGC

TGAGTTTGCA GAAGTTTCCA AGTTAGTGAC AGATCTTACC

AAAGTCCACACGGAATGCTG CCATGGAGAT CTGCTTGAAT

GTGCTGATGA CAGGGCGGAC CTTGCCAAGTATATCTGTGA

AAATCAAGAT TCGATCTCCA GTAAACTGAA GGAATGCTGT

GAAAAACCTCTGTTGGAAAA ATCCCACTGC ATTGCCGAAG

TGGAAAATGA TGAGATGCCT GCTGACTTGCCTTCATTAGC

TGCTGATTTT GTTGAAAGTA AGGATGTTTG CAAAAACTAT

GCTGAGGCAAAGGATGTCTT CCTGGGCATG TTTTTGTATG

AATATGCAAG AAGGCATCCT GATTACTCTGTCGTGCTGCT

GCTGAGACTT GCCAAGACAT ATGAAACCAC TCTAGAGAAG

TGCTGTGCCGCTGCAGATCC TCATGAATGC TATGCCAAAG

TGTTCGATGA ATTTAAACCT CTTGTGGAAGAGCCTCAGAA

TTTAATCAAA CAAAATTGTG AGCTTTTTGA GCAGCTTGGA

GAGTACAAATTCCAGAATGC GCTATTAGTT CGTTACACCA

AGAAAGTACC CCAAGTGTCA ACTCCAACTCTTGTAGAGGT

CTCAAGAAAC CTAGGAAAAG TGGGCAGCAA ATGTTGTAAA

CATCCTGAAGCAAAAAGAAT GCCCTGTGCA GAAGACTATC

-continued

```
TATCCGTGGT CCTGAACCAG TTATGTGTGTTGCATGAGAA

AACGCCAGTA AGTGACAGAG TCACCAAATG CTGCACAGAA

TCCTTGGTGAACAGGCGACC ATGCTTTTCA GCTCTGGAAG

TCGATGAAAC ATACGTTCCC AAAGAGTTTAATGCTGAAAC

GTTCACCTTC CATGCAGATA TATGCACACT TTCTGAGAAG

GAGAGACAAATCAAGAAACA AACTGCACTT GTTGAGCTTG

TGAAACACAA GCCCAAGGCA ACAAAAGAGCAACTGAAAGC

TGTTATGGAT GATTTCGCAG CTTTTGTAGA GAAGTGCTGC

AAGGCTGACGATAAGGAGAC CTGCTTTGCC GAGGAGGGTA

AAAAACTTGT TGCTGCAAGT CAAGCTGCCTTAGGCTTATA A.
```

The amino acid sequence of human albumin (SEQ ID NO: 513)
DAHKSEVAHRFKDLGEENFKALVLIAFAQYLQQCPFEDHVKLVNEVTEF

AKTCVADESAENCDKSLHTLFGDKLCTVATLRETYGEMADCCAKQEPER

NECFLQHKDDNPNLPRLVRPEVDVMCTAFHDNEETFLKKYLYEIARRHP

YFYAPELLFFAKRYKAAFTECCQAADKAACLLPKLDELRDEGKASSAKQ

RLKCASLQKFGERAFKAWAVARLSQRFPKAEFAEVSKLVTDLTKVHTEC

CHGDLLECADDRADLAKYICENQDSISSKLKECCEKPLLEKSHCIAEVE

NDEMPADLPSLAADFVESKDVCKNYAEAKDVFLGMFLYEYARRHPDYSV

VLLLRLAKTYETTLEKCCAAADPHECYAKVFDEFKPLVEEPQNLIKQNC

ELFEQLGEYKFQNALLVRYTKKVPQVSTPTLVEVSRNLGKVGSKCCKHP

EAKRMPCAEDYLSVVLNQLCVLHEKTPVSDRVTKCCTESLVNRRPCFSA

LEVDETYVPKEFNAETFTFHADICTLSEKERQIKKQTALVELVKHKPKA

TKEQLKAVMDDFAAFVEKCCKADDKETCFAEEGKKLVAASQAALGL.

The strategies for connection of human albumin to several above-mentioned fusion genes, the construction, and expression of the fusion protein are the same as those in construction of the fusion gene for the GLP-1 receptor binding polypeptide-linking group-IL-1Ra and expression of the fusion protein.

The cDNA sequence for the GIP-linking group-IL-1Ra (comprising two copies of the linking group)

(SEQ ID NO: 514)
```
TACGCGGAAGGGACTTTCATCAGTGACTACAGTATTGCCATGGACAAGA

TTCACCAACAAGACTTTGTGAACTGGCTGCTGGCCCAAAAGGGGAAGAA

GAATGACTGGAAACACAACATCACCCAGGGCGGCGGCGGCTCGGGCGGC

GGCGGCTCGCGACCCTCTGGGAGAAAATCCAGCAAGATGCAAGCCTTCA

GAATCTGGGATGTTAACCAGAAGACCTTCTATCTGAGGAACAACCAACT

AGTTGCTGGATACTTGCAAGGACCAAATGTCAATTTAGAAGAAAAGATA

GATGTGGTACCCATTGAGCCTCATGCTCTGTTCTTGGGAATCCATGGAG

GGAAGATGTGCCTGTCCTGTGTCAAGTCTGGTGATGAGACCAGACTCCA

GCTGGAGGCAGTTAACATCACTGACCTGAGCGAGAACAGAAAGCAGGAC

AAGCGCTTCGCCTTCATCCGCTCAGACAGTGGCCCCACCACCAGTTTTG

AGTCTGCCGCCTGCCCCGGTTGGTTCCTCTGCACAGCGATGGAAGCTGA

CCAGCCCGTCAGCCTCACCAATATGCCTGACGAAGGCGTCATGGTCACC

AAATTCTACTTCCAGGAGGACGAGTAG.
```

The amino acid sequence of the GIP receptor binding polypeptide-linking group-IL-1Ra (comprising two copies of the linking group) (non-acylated GI-4 at N-terminal)

(SEQ ID NO: 158)
YAEGTFISDYSIAMDKIHQQDFVNWLLAQKGKKNDWKHNITQGGGGSGG

GGSRPSGRKSSKMQAFRIWDVNQKTFYLRNNQLVAGYLQGPNVNLEEKI

DVVPIEPHALFLGIHGGKMCLSCVKSGDETRLQLEAVNITDLSENRKQD

KRFAFIRSDSGPTTSFESAACPGWFLCTAMEADQPVSLTNMPDEGVMVT

KFYFQEDE.

(2,5-dioxopyrrolidin-1-yl)acetate

Acetic acid (1.5 g, 25 mM) was dissolved in methylene chloride (15 ml), DCC (5.16 g, 25 mM) and a solution of N-hydroxyl butanimide (2.88 g, 25 mM) in dioxan (5 ml) was added, stirred at 4° C. overnight, and at room temperature for 2 h. The mixture was filtered, the solvent was evaporated under a reduced pressure, petroleum ether (b.p. 60-80° C.) was added, the crystal was filtered and recrystallized in ethyl acetate to yield a colourless needle product (3.75 g, yield: 95.5%), m.p. 131-134° C.

Acylation of the N-terminus of the GIP fusion protein

The single chain fusion protein of GIP receptor binding polypeptide and interleukin-1 receptor antagonistic protein was prepared according to the above procedure. With respect to the fusion proteins which need to be acylated at the N-terminus, such as GI-2 to GI-5, GI-13 to 15, GI-22, etc., the fusion proteins were dissolved in 0.01 NHCl, the resultant solution was adjusted with NaOH to pH 6.9, the equimolar amount of (2,5-dioxopyrrolidin-1-yl) acetate salt was added with one tenth of the amount added each time and the alkali solution was added every 30 min to keep at pH 6.9. The reaction was stirred overnight and purified on RP-HPLC C18 column. Buffer A: 0.1% TFA in aqueous solution, 10% acetonitrile; buffer B: 0.1% TFA in aqueous solution, 80% acetonitrile.

With the above-mentioned method, single chain fusion proteins of the GLP-1 receptor binding polypeptide and the interleukin-1 receptor antagonistic protein were prepared, their molecular weights were determined with mass spectrometry, and the synthesized compounds were verified by determining the structure of the single chain polypeptide through sequencing, with the results as follows:

G-1: the calculated molecular weight value thereof is 21296.0 and the molecular weight determined by mass spectrometry is 21298.3, with the sequencing result consistent with the sequence shown in the instant application;

G-2: the calculated molecular weight value thereof is 21611.3 and the molecular weight determined by mass spectrometry is 21613.4, with the sequencing result consistent with the sequence shown in the instant application;

G-3: the calculated molecular weight value thereof is 21926.5 and the molecular weight determined by mass spectrometry is 21928.1, with the sequencing result consistent with the sequence shown in the instant application;

G-4: the calculated molecular weight value thereof is 22241.8 and the molecular weight determined by mass spectrometry is 22243.2, with the sequencing result consistent with the sequence shown in the instant application;
G-5: the calculated molecular weight value thereof is 20518.1 and the molecular weight determined by mass spectrometry is 20520.6, with the sequencing result consistent with the sequence shown in the instant application;
G-6: the calculated molecular weight value thereof is 20719.3 and the molecular weight determined by mass spectrometry is 20721.0, with the sequencing result consistent with the sequence shown in the instant application;
G-7: the calculated molecular weight value thereof is 21034.6 and the molecular weight determined by mass spectrometry is 21035.8, with the sequencing result consistent with the sequence shown in the instant application;
G-8: the calculated molecular weight value thereof is 21349.9 and the molecular weight determined by mass spectrometry is 21351.7, with the sequencing result consistent with the sequence shown in the instant application;
G-18: the calculated molecular weight value thereof is 20522.1 and the molecular weight determined by mass spectrometry is 20524.3, with the sequencing result consistent with the sequence shown in the instant application;
G-19: the calculated molecular weight value thereof is 20780.3 and the molecular weight determined by mass spectrometry is 20781.8, with the sequencing result consistent with the sequence shown in the instant application;
G-20: the calculated molecular weight value thereof is 21095.6 and the molecular weight determined by mass spectrometry is 21098.0, with the sequencing result consistent with the sequence shown in the instant application;
G-21: the calculated molecular weight value thereof is 21410.9 and the molecular weight determined by mass spectrometry is 21412.4, with the sequencing result consistent with the sequence shown in the instant application;
G-22: the calculated molecular weight value thereof is 21873.5 and the molecular weight determined by mass spectrometry is 21875.6, with the sequencing result consistent with the sequence shown in the instant application;
G-81: the calculated molecular weight value thereof is 89011.3 and the molecular weight determined by mass spectrometry is 89013.6, with the sequencing result consistent with the sequence shown in the instant application;
G-82: the calculated molecular weight value thereof is 88958.2 and the molecular weight determined by mass spectrometry is 88960.1, with the sequencing result consistent with the sequence shown in the instant application;
G-83: the calculated molecular weight value thereof is 89011.3 and the molecular weight determined by mass spectrometry is 89013.0, with the sequencing result consistent with the sequence shown in the instant application;
G-84: the calculated molecular weight value thereof is 88958.2 and the molecular weight determined by mass spectrometry is 88960.5, with the sequencing result consistent with the sequence shown in the instant application.

With the above-mentioned method, fusion proteins were prepared on the basis of insulin receptor binding polypeptide and interleukin-1 receptor antagonistic protein, their molecular weights were determined with mass spectrometry, and the synthesized compounds were verified by determining the structure of the single chain polypeptide through sequencing, with the results as follows:
IN-1: the calculated molecular weight value thereof is 23900.0 and the molecular weight determined by mass spectrometry is 23902.8, with the sequencing result consistent with the sequence shown in the instant application;
IN-2: the calculated molecular weight value thereof is 23884.0 and the molecular weight determined by mass spectrometry is 23886.7, with the sequencing result consistent with the sequence shown in the instant application;
IN-3: the calculated molecular weight value thereof is 23835.8 and the molecular weight determined by mass spectrometry is 23837.2, with the sequencing result consistent with the sequence shown in the instant application;
IN-4: the calculated molecular weight value thereof is 24215.3 and the molecular weight determined by mass spectrometry is 24317.5, with the sequencing result consistent with the sequence shown in the instant application;
IN-5: the calculated molecular weight value thereof is 24199.2 and the molecular weight determined by mass spectrometry is 24151.3, with the sequencing result consistent with the sequence shown in the instant application;
IN-6: the calculated molecular weight value thereof is 24151.1 and the molecular weight determined by mass spectrometry is 24153.7, with the sequencing result consistent with the sequence shown in the instant application;
IN-7: the calculated molecular weight value thereof is 24530.6 and the molecular weight determined by mass spectrometry is 24532.4, with the sequencing result consistent with the sequence shown in the instant application;
IN-8: the calculated molecular weight value thereof is 24514.5 and the molecular weight determined by mass spectrometry is 24517.1, with the sequencing result consistent with the sequence shown in the instant application;
IN-9: the calculated molecular weight value thereof is 24466.4 and the molecular weight determined by mass spectrometry is 24469.0, with the sequencing result consistent with the sequence shown in the instant application;
IN-10: the calculated molecular weight value thereof is 24845.9 and the molecular weight determined by mass spectrometry is 24847.3, with the sequencing result consistent with the sequence shown in the instant application;
IN-11: the calculated molecular weight value thereof is 24829.8 and the molecular weight determined by mass spectrometry is 24830.9, with the sequencing result consistent with the sequence shown in the instant application;
IN-12: the calculated molecular weight value thereof is 24781.6 and the molecular weight determined by mass spectrometry is 24783.0, with the sequencing result consistent with the sequence shown in the instant application;
IN-13: the calculated molecular weight value thereof is 23309.3 and the molecular weight determined by mass spectrometry is 23311.2, with the sequencing result consistent with the sequence shown in the instant application;
IN-14: the calculated molecular weight value thereof is 23293.3 and the molecular weight determined by mass spectrometry is 23295.1, with the sequencing result consistent with the sequence shown in the instant application;
IN-15: the calculated molecular weight value thereof is 23245.1 and the molecular weight determined by mass spectrometry is 23246.8, with the sequencing result consistent with the sequence shown in the instant application;
IN-16: the calculated molecular weight value thereof is 23624.6 and the molecular weight determined by mass spectrometry is 23626.5, with the sequencing result consistent with the sequence shown in the instant application;
IN-17: the calculated molecular weight value thereof is 23608.6 and the molecular weight determined by mass spectrometry is 23610.0, with the sequencing result consistent with the sequence shown in the instant application;
IN-18: the calculated molecular weight value thereof is 23560.4 and the molecular weight determined by mass spectrometry is 23561.7, with the sequencing result consistent with the sequence shown in the instant application;

IN-19: the calculated molecular weight value thereof is 23939.9 and the molecular weight determined by mass spectrometry is 23941.6, with the sequencing result consistent with the sequence shown in the instant application;
IN-20: the calculated molecular weight value thereof is 23923.9 and the molecular weight determined by mass spectrometry is 23925.3, with the sequencing result consistent with the sequence shown in the instant application;
IN-21: the calculated molecular weight value thereof is 23875.7 and the molecular weight determined by mass spectrometry is 23877.2, with the sequencing result consistent with the sequence shown in the instant application;
IN-22: the calculated molecular weight value thereof is 24255.2 and the molecular weight determined by mass spectrometry is 24256.9, with the sequencing result consistent with the sequence shown in the instant application;
IN-23: the calculated molecular weight value thereof is 24239.1 and the molecular weight determined by mass spectrometry is 24241.5, with the sequencing result consistent with the sequence shown in the instant application;
IN-24: the calculated molecular weight value thereof is 24191.0 and the molecular weight determined by mass spectrometry is 24192.6, with the sequencing result consistent with the sequence shown in the instant application;
IN-62: the calculated molecular weight value thereof is 24530.6 and the molecular weight determined by mass spectrometry is 24537.1, with the sequencing result consistent with the sequence shown in the instant application;
IN-63: the calculated molecular weight value thereof is 24514.5 and the molecular weight determined by mass spectrometry is 24525.5, with the sequencing result consistent with the sequence shown in the instant application;
IN-64: the calculated molecular weight value thereof is 24466.4 and the molecular weight determined by mass spectrometry is 24474.7, with the sequencing result consistent with the sequence shown in the instant application;
IN-65: the calculated molecular weight value thereof is 24503.6 and the molecular weight determined by mass spectrometry is 24515.4, with the sequencing result consistent with the sequence shown in the instant application;
IN-66: the calculated molecular weight value thereof is 25064.2 and the molecular weight determined by mass spectrometry is 25073.6, with the sequencing result consistent with the sequence shown in the instant application;
IN-67: the calculated molecular weight value thereof is 24933.0 and the molecular weight determined by mass spectrometry is 24942.0, with the sequencing result consistent with the sequence shown in the instant application;
IN-68: the calculated molecular weight value thereof is 91615.4 and the molecular weight determined by mass spectrometry is 91624.9, with the sequencing result consistent with the sequence shown in the instant application;
IN-69: the calculated molecular weight value thereof is 91615.4 and the molecular weight determined by mass spectrometry is 91627.2, with the sequencing result consistent with the sequence shown in the instant application;
IN-70: the calculated molecular weight value thereof is 91730.6 and the molecular weight determined by mass spectrometry is 91623.3, with the sequencing result consistent with the sequence shown in the instant application.

With the above-mentioned method, fusion proteins were prepared on the basis of the GIP receptor binding polypeptide and the interleukin-1 receptor antagonistic protein, their molecular weights were determined with mass spectrometry, and the synthesized compounds were verified by determining the structure of the single chain polypeptide through sequencing, with the results as follows:

GI-1: the calculated molecular weight value thereof is 22423.2 and the molecular weight determined by mass spectrometry is 22427.0, with the sequencing result consistent with the sequence shown in the instant application;
GI-2: the calculated molecular weight value thereof is 22134.0 and the molecular weight determined by mass spectrometry is 22138.1, with the sequencing result consistent with the sequence shown in the instant application;
GI-3: the calculated molecular weight value thereof is 22449.2 and the molecular weight determined by mass spectrometry is 22456.3, with the sequencing result consistent with the sequence shown in the instant application;
GI-4: the calculated molecular weight value thereof is 22764.5 and the molecular weight determined by mass spectrometry is 22772.4, with the sequencing result consistent with the sequence shown in the instant application;
GI-5: the calculated molecular weight value thereof is 23079.8 and the molecular weight determined by mass spectrometry is 23090.7, with the sequencing result consistent with the sequence shown in the instant application;
GI-6: the calculated molecular weight value thereof is 22060.0 and the molecular weight determined by mass spectrometry is 22068.5, with the sequencing result consistent with the sequence shown in the instant application;
GI-7: the calculated molecular weight value thereof is 22375.2 and the molecular weight determined by mass spectrometry is 22384.6, with the sequencing result consistent with the sequence shown in the instant application;
GI-8: the calculated molecular weight value thereof is 22690.5 and the molecular weight determined by mass spectrometry is 22695.9, with the sequencing result consistent with the sequence shown in the instant application;
GI-9: the calculated molecular weight value thereof is 23005.8 and the molecular weight determined by mass spectrometry is 23009.2, with the sequencing result consistent with the sequence shown in the instant application;
GI-10: the calculated molecular weight value thereof is 21381.0 and the molecular weight determined by mass spectrometry is 21373.4, with the sequencing result consistent with the sequence shown in the instant application;
GI-11: the calculated molecular weight value thereof is 22351.0 and the molecular weight determined by mass spectrometry is 22360.8, with the sequencing result consistent with the sequence shown in the instant application;
GI-12: the calculated molecular weight value thereof is 21720.4 and the molecular weight determined by mass spectrometry is 21724.1, with the sequencing result consistent with the sequence shown in the instant application;
GI-13: the calculated molecular weight value thereof is 22407.0 and the molecular weight determined by mass spectrometry is 22411.5, with the sequencing result consistent with the sequence shown in the instant application;
GI-14: the calculated molecular weight value thereof is 22091.7 and the molecular weight determined by mass spectrometry is 22097.6, with the sequencing result consistent with the sequence shown in the instant application;
GI-15: the calculated molecular weight value thereof is 21776.5 and the molecular weight determined by mass spectrometry is 21782.4, with the sequencing result consistent with the sequence shown in the instant application;
GI-16: the calculated molecular weight value thereof is 20750.4 and the molecular weight determined by mass spectrometry is 20753.9, with the sequencing result consistent with the sequence shown in the instant application;
GI-17: the calculated molecular weight value thereof is 20435.1 and the molecular weight determined by mass spectrometry is 20438.7, with the sequencing result consistent with the sequence shown in the instant application;
GI-18: the calculated molecular weight value thereof is 21528.2 and the molecular weight determined by mass spectrometry is 21534.2, with the sequencing result consistent with the sequence shown in the instant application;
GI-19: the calculated molecular weight value thereof is 20609.3 and the molecular weight determined by mass spectrometry is 20613.3, with the sequencing result consistent with the sequence shown in the instant application;
GI-20: the calculated molecular weight value thereof is 21702.5 and the molecular weight determined by mass spectrometry is 21709.0, with the sequencing result consistent with the sequence shown in the instant application;
GI-21: the calculated molecular weight value thereof is 22017.7 and the molecular weight determined by mass spectrometry is 22025.6, with the sequencing result consistent with the sequence shown in the instant application;
GI-22: the calculated molecular weight value thereof is 89218.7 and the molecular weight determined by mass spectrometry is 89227.1, with the sequencing result consistent with the sequence shown in the instant application;
GI-23: the calculated molecular weight value thereof is 89144.7 and the molecular weight determined by mass spectrometry is 89153.5, with the sequencing result consistent with the sequence shown in the instant application.

Chemical Synthesis of Polypeptides

Linear polypeptides can be synthesized by Boc solid phase polypeptide synthesis or Fmoc solid phase polypeptide synthesis. If a polypeptide with a carboxyl group at the C-terminus is chemically synthesized by Fmoc method, Wang resin would be selected, while if a polypeptide with an amide at the C-terminus, Rink amide resin would be selected. If a polypeptide with a carboxyl group at the C-terminus is chemically synthesized by Boc method, Pam resin would be selected, while if a polypeptide with an amide at the C-terminus, MBHA resin would be selected. The condensation agents and activating agents are DIC and HOBT. Other alternative condensation agents include BOP, HBTU, DEPBT, etc. Amino acids are used 5 folds in excess and the time period for condensation is 1 hour.

Fmoc protective group can be removed by 50% piperidine/DMF and Boc protective group can be cleaved by TFA. Peptide bond condensation can be monitored by ninhydrin (2,2-Dihydroxyindane-1,3-dione) test.

In Fmoc solid phase polypeptide synthesis, the commonly used amino acids and protective groups are as follows:
Fmoc-Cys(Trt)-OH, Fmoc-Asp(OtBu)-OH, Fmoc-Glu(OtBu)-OH, Fmoc-His(Trt)-OH, Fmoc-Lys(Boc)-OH, Fmoc-Asn(Trt)-OH, Fmoc-Gln(Trt)-OH, Fmoc-Arg(Pmc)-OH, Fmoc-Ser(tBu)-OH, Fmoc-Thr(tBu)-OH, Boc-Trp(Boc)-OH or Fmoc-Tyr(tBu)-OH.

If the side chain amino group of lysine is used for acylation, side chain amino group of lysine could be protected by allyloxycarbonyl (aloc) group. Upon completion of synthesis of peptide sequence, allyloxycarbonyl (aloc) group can be removed using tetrakis(triphenylphosphine)palladium(0) along with a 37:2:1 mixture of DCM, acetic acid, and NMM (15 ml/g resin) in an argon atmosphere by stirring at ambient temperature for 2 hours. After reaction, the resin should be washed with 0.5% DIPEA/DMF (10 ml), 0.5% sodium diethyldithiocarbamate trihydrate/DMF (3×10 ml), and 1:1 DCM:DMF (5×10 ml). The side chain amino group of lysine may also be protected by 4-methyltrityl group (Mtt). The resin is suspended in DCM, followed by addition of TFA/TIS/DCM (1:2:97), vibrated for 10 minutes, repeated twice, and then washed with DCM, DMF and isopropyl alcohol.

After a polypeptide is synthesized by Fmoc solid phase synthesis, the cleavage reagent commonly used is a TFA. The dry resin was placed into a shaking flask, filled with an appropriate amount of TFA/TIS/H$_2$O (95:2.5:2.5, 10-25 mL/g resin), capped with a cover, and subjected to batch-type rotary shaking at room temperature. After 2 h, the resin was subjected to suction filtration and washed 2-3 times with fresh TFA; the filtrates were pooled, and 8-10 volumes of iced ethyl ether was added dropwise. Finally, the precipitated polypeptide crude was collected by centrifugation.

In Boc solid phase polypeptide synthesis, the commonly used amino acids and protective groups are as follows:
Boc-Cys(4-MeBzl)-OH, Boc-Asp(OcHx)-OH, Boc-Glu(OcHx)-OH, Boc-His(Bom)-OH, Boc-Lys(2-Cl—Z)—OH, Boc-Asn(Xan)-OH, Boc-Arg(Tos)-OH, Boc-Ser(Bzl)-OH, Boc-Thr(Bzl)-OH, Boc-Trp(CHO)—OH and Boc-Tyr(2-Br—Z)—OH.

If the side chain amino group of a lysine is used for formation of lactam or acylation reaction, side chain amino group of lysine may be protected by allyloxycarbonyl (aloc) or Fmoc group. If carboxyl of the side chain of glutamic acid or aspartic acid is used for formation of lactam or acylation reaction, the carboxyl may be converted to an allyl ester or be protected by 9-Fluorenylmethyl group.

After a polypeptide is synthesized by solid phase Boc synthesis, PAM and MBHA resins are usually cleaved by HF. For 0.1 mM resin, 5 ml of HF, together with p-cresol, p-hydroxy thiophenol, or anisole etc are added. The mixture is stirred at ice bath temperature for 1 hour. After HF is evaporated in vacuo, the polypeptide is precipitated with iced ethyl ether and collected by centrifugation. The final product is obtained after HPLC purification and subjected to freeze drying.

Preparation of Tert-Butyl Hexadecandioyl-L-Glu(OSu)-OtBu 5.72 g (20 mM) of hexadecanedioic acid was dissolved in 240 mL of anhydrous DMF and cooled in an ice bath. 1.48 g (20 mM) of 2-methyl-2-propyl alcohol, 2.7 g (2.25 mL, 21.4 mM) of DIC, 2.88 g (21.4 mM) of HOBT, 2.16 g (2.34 mL, 21.4 mM) of NMM, and 244 mg (2 mM) of DMAP were addedsuccessively. The mixture was stirred at room temperature overnight. 80 mL of water was added, acidified to pH 3, and extracted with ethyl acetate (80 mL×3). The organic layer was washed with 0.1 NHCl and saturated saline, dried over magnesium sulphate, and the solvent was evaporated under a reduced pressure to obtain mono-tert-butyl hexadecandioate (3.32 g, yield: 47%). Data for nuclear magnetic resonance were $^1$H-NMR (CDCl$_3$) δ 2.35 (t, 2H), 1.56-1.66 (m, 4H), 1.44 (s, 9H), 1.21-1.35 (m, 20H).

4.25 g (10 mM) of Fmoc-Glu-OtBu was dissolved in 30 mL of DCM, transferred into 3 g of 2-CTC resin (2-chlorotritylchloride resin, sub. 1 mM/g), and followed by adding 1.29 g (10 mM, 1.74 mL) of DIPEA. After the mixture was shaken in a shaker for 5 min, 1.93 g (15 mM, 2.6 mL) of DIPEA was further added. The mixture was shaken vigorously for one hour. To the resin was added 2.4 mL of HPLC-grade methanol and mixed for 15 min. The resin was filtered, washed with DCM (3×30 mL), DMF (2×30 mL), DCM (3×30 mL), methanol (3×30 mL) and then desiccated in vacuum.

After Fmoc was deprotected with piperidine, 3 g of the resin (3 mM) and 3.43 g (10 mM) of mono-tert-butyl hexadecandioate were added to 50 mL of anhydrous DMF, and 1.35 g (1.12 mL, 10.7 mM) of DIC, 1.44 g (10.7 mM) of HOBT, 1.3 g (10 mM, 1.74 mL) of DIPEA were added successively. After agitated at room temperature overnight, the resin was rinsed with DMF (2×30 mL) and DCM (2×30 mL).

A cleavage solution of AcOH/TFE/DCM (1:1:8) (20 mL/g resin) was prepared. The resin was suspended in half of the cleavage solution, and placed at room temperature for 30 min. The resin was filtered and washed three times with another half of the cleavage solution. The filtrates were mixed and 15 volumes of n-hexane were added. Excessive acetic acid was removed by rotary evaporation to yield tert-butyl hexadecandioyl -L-Glu-OtBu. $^1$H-NMR (CDCl$_3$): δ 6.25 (d, 1H), 4.53 (m, 1H), 2.42 (m, 2H), 2.21 (m, 4H), 1.92 (m, 1H), 1.58 (m, 4H), 1.47 (s, 9H), 1.22-1.43 (m, 18H).

1 g (1.9 mM) of tert-butyl hexadecandioyl-L-Glu-OtBu was dissolved in 5 mL of anhydrous DMF/DCM (1 mL:4 mL). 0.412 g (2 mM) of DCC and 0.23 g (2 mM) of N-hydroxyl succinimide were added. The mixture was stirred at room temperature overnight. The mixture was filtered. The filtrate was diluted with ethyl acetate, washed with 0.1 NHCl and saturated saline, dried over magnesium sulphate, and evaporated under a reduced pressure to obtain tert-butyl hexadecandioyl-L-Glu (OSu)-OtBu. $^1$H-NMR (CDCl$_3$): δ 6.17 (d, 1H), 4.60 (m, 1H), 2.84 (s, 4H), 2.72 (m, 1H), 2.64 (m, 1H), 2.32 (m, 1H), 2.20 (m, 4H), 2.08 (m, 1H), 1.6 (m, 4H), 1.47 (s, 9H), 1.43 (s, 9H), 1.20-1.33 (m, 20H).

Tert-butyl octadecandioyl-L-Glu(OSu)-OtBu was prepared in the same procedure.

Acylation of the Protein/Polypeptide (1)

The single chain insulin analogue (10 μmol) was dissolved in 0.01NHCl at room temperature, and 0.01NNaOH was added dropwise to pH 7. Tert-butyl hexadecandioyl-L-Glu (OSu)-OtBu (12 μmol) was dissolved in acetonitrile (2 mL), and the solution of polypeptide was added. After stirred for 30 min, the mixture was acidified with 50% acetic acid, and loaded onto a RP-HPLC C5 column for purification. Buffer A: 0.1% TFA aqueous solution, 10% acetonitrile; buffer B: 0.1% TFA aqueous solution, 80% acetonitrile. The polypeptide initially purified and lyophilized was placed into TFA/TIS/H$_2$O (95:2.5:2.5, 10 mL). Thirty minutes later, the solvent was evaporated under a reduced pressure and the crude product was dissolved in Buffer A and lyophilized. Purification was performed using the RP-HPLC C5 column, with buffer A: 0.1% TFA aqueous solution, 10% acetonitrile and buffer B: 0.1% TFA aqueous solution, 80% acetonitrile. The acylated single chain insulin analogue was dissolved in 100 mM Na$_2$CO$_3$ (2 mL). Maleimide-PEG12-NHS (12 μmol) was added and stirred for 30 min, interleukin-1 receptor antagonistic protein (11 μmol) was added. After stirred for 5 hours, the mixture was acidified with 50% acetic acid, and loaded onto a RP-HPLC C5 column for purification. Buffer A: 0.1% TFA aqueous solution, 10% acetonitrile; buffer B: 0.1% TFA aqueous solution, 80% acetonitrile.

With the above-mentioned method, fusion proteins were prepared on the basis of the insulin receptor binding polypeptide and the interleukin-1 receptor antagonistic protein, and their molecular weights were determined with mass spectrometry as follows:

IN-33: the calculated molecular weight value thereof is 25135.4 and the molecular weight determined by mass spectrometry is 25136.9, with the sequencing result consistent with the sequence shown in the instant application;

IN-34: the calculated molecular weight value thereof is 25108.4 and the molecular weight determined by mass spectrometry is 25110.5, with the sequencing result consistent with the sequence shown in the instant application.

Synthesis of 18-Maleimidooctadecanoic Acid

Methyl 18-hydroxyoctadecanoate (4.5 g, 14.3 mM) was dissolved in 50 ml dichloromethane. Pyridine (4.53 g, 57.2 mM) was added, and cooled in a ice bath, and then p-toluenesulfonyl chloride (5.46 g, 28.6 mM) was slowly added within 1 hour. Thereafter, reaction was carried out for 16 hours under stir and 4° C. The reaction mixture was washed with a iN hydrochloric acid aqueous solution, water, saturated sodium hydrogen carbonate solution, water and saturated saline solution successively, dried, and then concentrated under a reduced pressure. Then purified by silica gel column (eluent: benzene) to give methyl 18-tosyloxyoctadecanoate (5.69 g, 85%). m.p. 67.5-68.5° C. $^1$H-NMR (CDCl$_3$, 270 MHz): δ1.09-1.42 (m, 26H), 1.53-1.72 (m, 4H), 2.30 (t, 2H), 2.45 (s, 3H), 3.68 (s, 3H), 4.03 (t, 2H), 7.35 (d, 2H), 7.79 (d, 2H).

A mixture of potassium phthalimide (2.96 g, 16.0 mM) and 100 ml anhydrous DMF was heated to 110° C. 80 ml methyl 18-tosyloxyoctadecanoate (5.0 g, 10.7 mM) dissolved in DMF was added dropwise and the mixture was stirred at 110° C. for 2 hours. Ice water was poured to reach a total volume of 1.2 liter, and stirred for 30 minutes. Thereafter, the precipitates were filtered and dissolved in chloroform, and then washed with water and saturated saline solution, dried over magnesium sulfate, concentrated under a reduced pressure and purified by silica gel column (eluent: benzene and methylene chloride:2:1), to give methyl 18-phtahlimideocatadecanoate (4.15 g, 88%).m.p. 82-83° C.

$^1$H-NMR (CDCl$_3$, 270 MHz): δ1.09-1.42 (m, 26H), 1.53-1.76 (m, 4H), 2.30 (t, 2H), 3.66, 3.67 (s, t, 5H), 7.71 (m, 2H), 7.84 (m, 2H).

Methyl 18-phthalimideoctadecanoate (2.0 g, 4.51 mM), 30 ml ethanol and 80% hydrazine hydrate (0.42 ml, 6.76 mM) were heated and refluxed for 9 hours. 6N hydrochloric acid (11.3 ml, 67.6 mM) was added, heated and refluxed for 1 hour. The insoluble matter was filtered off, and the filtrate was concentrated under a reduced pressure. 30 ml of ethanol and 18.1 ml of 1N sodium hydroxide solution was added, heated and refluxed for 18 hours. The reaction was neutralized with 6N hydrochloric acid. The precipitates were collected by filtration and recrystallized in ethanol-acetic acid-water to give 18-aminooctadecanoic acid (800 mg, 59%). m.p. 172°-174° C. IR (cm$^{-1}$): 2920, 2850, 1640, 1535, 1470, 1400 FD-MS (m/z): [M+H]$^+$300.

18-aminooctadecanoic acid (400 mg, 1.33 mM) was dissolved in 50 ml of ethanol and 25 ml of iN sodium hydroxide, at 40° C. At the same temperature, maleic anhydride (1.97 g, 20.0 mM) was slowly added within 2 hours. The reaction mixture was stirred for 30 minutes, then acidified with hydrochloric acid and subjected to centrifugation. The precipitate was filtered and washed with water, and then dried under a reduced pressure, to give N-(17-carboxyheptadecyl)maleamic acid (436 mg, 88%). m.p. 144°-147.5° C. IR (cm$^{-1}$): 3305, 2920, 2850, 1710, 1630, 1585, 1470, 1400, 1280, 1250, 1230, 1215, 1195, 1180.

FD-MS (m/z): [M+H]$^+$398

N-(17-carboxyheptadecyl)maleamic acid (400 mg, 1.01 mM), 2.83 mlacetic anhydride, and anhydrous sodium acetate (41.0 rag, 0.50 mM) was heated to 100° C., stirred for 1 hour. After cooling of the reaction, ice was added and further stirred for 1 hour. The resulting mixture was extracted with chloroform. The organic layer was washed with water and then with saturated saline solution, dried over anhydrous magnesium sulfate, concentrated under a reduced pressure and purified by silica gel column (eluent:benzene and chloroform:1:1), to give 18-maleimidooctadecanoic acid (172 mg, 45%). m.p. 101-103° C.

$^1$H-NMR (CDCl$_3$, 270 MHz): δ1.14-1.40 (m, 26H), 1.48-1.72 (m, 4H), 2.35 (t, 2H), 3.50 (t, 2H), 6.68 (s, 2H)

IR(cm$^{-1}$): 2920, 2850, 1710, 1470, 1450, 1410, 840, 700

FD-MS (m/z): [M+H]$^+$380

Acylation of the protein/polypeptide (2): modification of the fusion protein by 18-maleimidooctadecanoic acid 3 ml aqueous solution of fusion protein (3 mg) was mixed with 0.8 ml of 0.5 M Tris-HCl buffer (pH 9), 18-maleimidooctadecanoic acid was added slowly (in a molar ratio of 1.1). The reaction was stirred at room temperature overnight. The reaction was filtered, the filtrate was added onto Sephadex G-25 (the eluent: 10 mM ammonium bicarbonate solution). Fractions with large molecular weights were collected, and purified with a DEAE-Sepharose Fast Flow ion exchange column (the eluent: 10 mM Tris-HCl (pH 8) and 0.075 M sodium chloride solution). The collected product was desalted with Sephadex G-25 (the eluent: 10 mM ammonium bicarbonate solution) and freeze dried to obtain the product.

With the above-mentioned method, fusion proteins were prepared on the basis of the GLP-1 receptor binding polypeptide and the interleukin-1 receptor antagonistic protein, and their molecular weights were determined with mass spectrometry as follows:

G-30: the calculated molecular weight value thereof is 22278.0 and the molecular weight determined by mass spectrometry is 22279.5, which is consistent with the compound shown in the instant application;

G-31: the calculated molecular weight value thereof is 22306.0 and the molecular weight determined by mass spectrometry is 22307.8, which is consistent with the compound shown in the instant application;

G-36: the calculated molecular weight value thereof is 22251.0 and the molecular weight determined by mass spectrometry is 22252.9, which is consistent with the compound shown in the instant application;

G-38: the calculated molecular weight value thereof is 22306.0 and the molecular weight determined by mass spectrometry is 22307.2, which is consistent with the compound shown in the instant application;

G-40: the calculated molecular weight value thereof is 21534.2 and the molecular weight determined by mass spectrometry is 21535.6, which is consistent with the compound shown in the instant application;

G-42: the calculated molecular weight value thereof is 21448.1 and the molecular weight determined by mass spectrometry is 21449.3, which is consistent with the compound shown in the instant application;

G-49: the calculated molecular weight value thereof is 21447.1 and the molecular weight determined by mass spectrometry is 21448.4, which is consistent with the compound shown in the instant application.

With the above-mentioned method, fusion proteins were prepared on the basis of the insulin receptor binding polypeptide and the interleukin-1 receptor antagonistic protein, and their molecular weights were determined with mass spectrometry as follows:

IN-28: the calculated molecular weight value thereof is 24264.4 and the molecular weight determined by mass spectrometry is 24266.1, which is consistent with the compound shown in the instant application.

Preparation of 16-(1-tert-butoxy-5-(4-(2,5-dioxo-2,5-dihydro-1H-pyrrol-1-yl)butylamino)-1,5-dioxopentyl-2-yl amino)-16-oxohexadecanoic acid Mono-Boc-butanediamine (N-t-butoxycarbonyl-1,4-butanediamine) (1.88 g, 10 mM) and maleic anhydride (1.22 g, 12.5 mM) were dissolved in anhydrous CH$_2$Cl$_2$ (30 ml), stirred at room temperature for 2 h, and filtered to collect white precipitates. The white precipitates were rinsed with CH$_2$Cl$_2$ and then desiccated under vacuum to be used directly in the next reaction. (Z)-4-(4-(tert-butoxycarbonylamino)butylamino)-4-oxobut-2-butenoic acid (2.4 g, 8.4 mM), acetic anhydride (20 ml) and anhydrous sodium acetate (1 g, 12.2 mM) were stirred at 140° C. for 6 hr. The mixture was poured into ice water and extracted with chloroform. The organic layer was washed with water and the saturated saline, dried over anhydrous magnesium sulphate, concentrated under a reduced pressure, and purified by a silica gel column (n-hexane:ethyl acetate=100/0:50/50 v/v), yielding white solid, butyl tert-butyl-4-(2,5-dioxo-2,5-dihydro-1H-pyrrol-1-yl) carbamate (1.71 g, 6.4 mM). $^1$H NMR (300 MHz, CDCl3): δ=6.68 (s, 2H, CH=CH), 4.50 (br, 1H, NHtBoc), 3.50 (t, 2H, CH$_2$N), 3.08 (q, 2H, CH$_2$NHtBoc), 1.60-1.25 (m, 1 3 H, CH$_2$).

Butyl tert-butyl-4-(2,5-dioxo-2,5-dihydro-1H-pyrrol-1-yl) carbamate was dissolved in 4NHCl/dioxane, stirred at room temperature for 1 h, and the solvent was evaporated under a reduced pressure to yield 1-(4-aminobutyl)-1H-pyrrolyl-2,5-dione. 1-(4-aminobutyl)-1H-pyrrolyl-2,5-dione (1 g, 6 mM) was dissolved in 100 mM Na$_2$CO$_3$ (1 mL, pH 8) and acetonitrile (2 mL) at room temperature. Tert-butyl hexadecandioyl-L-Glu (OSu)-OtBu (4.09 g, 7.2 mM) was dissolved in acetonitrile (4 mL), stirred for 30 min, acidified with 50% acetic acid, and loaded onto a RP-HPLC C5 column for purification, yielding 16-(1-tert-butoxy-5-(4-(2, 5-dioxo-2,5-dihydro-1H-pyrrol-1-yl)butylamino)-1,5-dioxopentyl-2-yl amino)-16-oxohexadecanoic acid.

Acylation of the protein/polypeptide (3)

The fusion protein and the equimolar amount of 16-(1-tert-butoxy-5-(4-(2,5-dioxo-2,5-dihydro-1H-pyrrolyl-1-yl) butylamino)-1,5-dioxopentyl-2-ylamino group)-16-oxohexadecanoic acid were dissolved in PBS with a polypeptide concentration of 10 mM. The reaction was run at room temperature for 1 h and subjected to HPLC purification. Buffer A: 0.1% TFA aqueous solution, 10% acetonitrile; buffer B: 0.1% TFA aqueous solution, 80% acetonitrile. The polypeptide initially purified and lyophilized was placed into TFA/TIS/H$_2$O (95:2.5:2.5, 10 mL). Thirty minutes later, the solvent was evaporated under vacuum and the crude product was dissolved in Buffer A and lyophilized. Purification was performed using the RP-HPLC C5 column, with buffer A: 0.1% TFA aqueous solution, 10% acetonitrile and buffer B: 0.1% TFA aqueous solution, 80% acetonitrile.

With the above-mentioned method, fusion proteins were prepared on the basis of the GLP-1 receptor binding polypeptide and the interleukin-1 receptor antagonistic protein, and their molecular weights were determined with mass spectrometry as follows:

G-9: the calculated molecular weight value thereof is 22177.0 and the molecular weight determined by mass spectrometry is 22179.5, which is consistent with the compound shown in the instant application;

G-12: the calculated molecular weight value thereof is 22465.2 and the molecular weight determined by mass spectrometry is 22467.1, which is consistent with the compound shown in the instant application;

G-14: the calculated molecular weight value thereof is 21258.0 and the molecular weight determined by mass spectrometry is 21259.6, which is consistent with the compound shown in the instant application;

G-15: the calculated molecular weight value thereof is 22135.9 and the molecular weight determined by mass spectrometry is 22137.3, which is consistent with the compound shown in the instant application;

G-17: the calculated molecular weight value thereof is 22423.1 and the molecular weight determined by mass spectrometry is 22424.7, which is consistent with the compound shown in the instant application;

G-25: the calculated molecular weight value thereof is 21319.0 and the molecular weight determined by mass spectrometry is 21320.4, which is consistent with the compound shown in the instant application;

G-27: the calculated molecular weight value thereof is 21634.3 and the molecular weight determined by mass spectrometry is 21636.0, which is consistent with the compound shown in the instant application;

G-29: the calculated molecular weight value thereof is 22439.2 and the molecular weight determined by mass spectrometry is 22441.1, which is consistent with the compound shown in the instant application.

With the above-mentioned method, fusion proteins were prepared on the basis of the insulin receptor binding polypeptide and the interleukin-1 receptor antagonistic protein, and their molecular weights were determined with mass spectrometry as follows:

IN-25: the calculated molecular weight value thereof is 25096.3 and the molecular weight determined by mass spectrometry is 25097.5, which is consistent with the compound shown in the instant application.

Preparation of

I—$CH_2$—CONH—$(CH_2CH_2O)_2$—$(CH_2)_2$—NH—($N^\alpha$-(tBuOOC$(CH_2)_{14}$CO)-γ-Glu-OtBu)

Ethyl Tert-butyl-N-[2-[2-(2-aminoethoxyl)ethoxy]ethyl]carbamate (2.48 g, 10 mM), 2-iodoacetic acid (2.05 g, 1 1 mM), EDC (1.72 g, 11 mM), and HOBT (1.49 g, 11 mM) were dissolved in anhydrous DMF and reacted at room temperature overnight. The reaction product was washed successively with 10% of hydrogen chloride aqueous solution, water, the saturated sodium hydrogen carbonate, water, and the saturated saline, dried, concentrated under a reduced pressure, and purified with a silica gel column, yielding tert-butyl-N-[2-[2-[2-[(2-iodoacetyl)amino]ethoxy]ethoxy]ethyl]carbamate.

Tert-butyl-N-[2-[2-[2-[(2-iodoacetyl)amino]ethoxy]ethoxy]ethyl]carbamate was dissolved in 4NHCl/dioxane, stirred at room temperature for 1 h, and the solvent was evaporated under a reduced pressure to yield N-[2-[2-(2-aminoethoxyl)ethoxy]ethyl]-2-iodo-ethylamide hydrochloride which can be used directly in the next reaction. N-[2-[2-(2-aminoethoxyl)ethoxy]ethyl]-2-iodo-ethylamide hydrochloride (1 g, 2.8 mM) was dissolved in 100 mM $Na_2CO_3$ (1 mL, pH 8) and acetonitrile (2 mL) at room temperature. Tert-butyl hexadecandioyl-L-Glu (OSu)-OtBu (1.42 g, 2.5 mM) was dissolved in acetonitrile (4 mL), stirred for 30 min, acidified with 50% acetic acid, and loaded onto a RP-HPLC C5 column for purification, yielding the final product, tert-butyl-16-[[1-(tert-butoxy)carbonyl-4-[2-[2-[2-[(2-iodoacetyl)amino]ethoxy]ethoxy]ethylamino]-4-oxo-butyl]amino]-16-oxo-palmitate. The calculated molecular weight is 825.4, and the determined molecular weight: 826.9.

I—$CH_2$—CONH—$(CH_2CH_2O)_4$—$(CH_2)_2$—NH—($N^\alpha$-(tBuOOC$(CH_2)_{16}$CO)-γ-Glu-OtBu) was prepared by a similar procedure.

Acylation of the Protein/Polypeptide (4)

The fusion protein and the equimolar amount of I—$CH_2$—CONH—$(CH_2CH_2O)_2$—$(CH_2)_2$—NH—($N^\alpha$—(HOOC$CH_2)_{14}$CO)-γ-Glu-OtBu) were dissolved in 50 mM Tris.HCl, 5 mM EDTA, pH 8.0 and reacted at room temperature in the dark for 90 minutes. Purification by HPLC. Buffer A: 0.1% TFA aqueous solution, 10% acetonitrile; buffer B: 0.1% TFA aqueous solution, 80% acetonitrile. The polypeptide initially purified and lyophilized was placed into TFA/TIS/$H_2O$ (95:2.5:2.5, 10 mL). Thirty minutes later, the solvent was evaporated under vacuum and the crude product was dissolved in Buffer A and lyophilized. Purification was performed using the RP-HPLC C5 column, with buffer A: 0.1% TFA aqueous solution, 10% acetonitrile and buffer B: 0.1% TFA aqueous solution, 80% acetonitrile.

With the above-mentioned method, fusion proteins were prepared on the basis of the GLP-1 receptor binding polypeptide and the interleukin-1 receptor antagonistic protein, and their molecular weights were determined with mass spectrometry as follows:

G-32: the calculated molecular weight value thereof is 22512.3 and the molecular weight determined by mass spectrometry is 22513.4, which is consistent with the compound shown in the instant application;

G-33: the calculated molecular weight value thereof is 22471.3 and the molecular weight determined by mass spectrometry is 22473.1, which is consistent with the compound shown in the instant application;

G-34: the calculated molecular weight value thereof is 22443.2 and the molecular weight determined by mass spectrometry is 22445.0, which is consistent with the compound shown in the instant application;

G-35: the calculated molecular weight value thereof is 22512.3 and the molecular weight determined by mass spectrometry is 22513.2, which is consistent with the compound shown in the instant application;

G-37: the calculated molecular weight value thereof is 22485.3 and the molecular weight determined by mass spectrometry is 22487.1, which is consistent with the compound shown in the instant application;

G-39: the calculated molecular weight value thereof is 22628.3 and the molecular weight determined by mass spectrometry is 22630.6, which is consistent with the compound shown in the instant application;

G-41: the calculated molecular weight value thereof is 21768.5 and the molecular weight determined by mass spectrometry is 21770.4, which is consistent with the compound shown in the instant application;

G-43: the calculated molecular weight value thereof is 21640.3 and the molecular weight determined by mass spectrometry is 21642.7, which is consistent with the compound shown in the instant application;

G-44: the calculated molecular weight value thereof is 21582.3 and the molecular weight determined by mass spectrometry is 21583.9, which is consistent with the compound shown in the instant application;

G-45: the calculated molecular weight value thereof is 21798.5 and the molecular weight determined by mass spectrometry is 21800.4, which is consistent with the compound shown in the instant application;

G-46: the calculated molecular weight value thereof is 21611.3 and the molecular weight determined by mass spectrometry is 21612.9, which is consistent with the compound shown in the instant application;

G-47: the calculated molecular weight value thereof is 21640.3 and the molecular weight determined by mass spectrometry is 21642.2, which is consistent with the compound shown in the instant application;

G-48: the calculated molecular weight value thereof is 21785.5 and the molecular weight determined by mass spectrometry is 21787.6, which is consistent with the compound shown in the instant application;

G-50: the calculated molecular weight value thereof is 21681.4 and the molecular weight determined by mass spectrometry is 21682.8, which is consistent with the compound shown in the instant application.

With the above-mentioned method, fusion proteins were prepared on the basis of the insulin receptor binding polypeptide and the interleukin-1 receptor antagonistic protein, and their molecular weights were determined with mass spectrometry as follows:

IN-26: the calculated molecular weight value thereof is 25089.4 and the molecular weight determined by mass spectrometry is 25091.6, which is consistent with the compound shown in the instant application.

Modification of the Polypeptide by Polyethylene Glycol (PEGylation):

1. The Amino Group (at the N-Terminus of the Main Chain or on the Side Chain of a Lysine)

a) Reductive Alkylation

The fusion protein, mPEG20K—CHO, sodium cyanoborohydride (NaBH$_3$CN) in a ratio of 1:2:45 were dissolved in a solution of acetic acid, pH 4.3 (0.1 M NaCl, 0.2 M CH$_3$COOH, 0.1 M Na$_2$CO$_3$). Protein concentration is 0.5-1 mg/mL. The reaction was monitored and purified by HPLC. Yield is about 55%. Polyethylene glycol can be selectively attached at the N-terminus of the polypeptide through reductive alkylation.

b) Acylation of NHS ester (N-hydroxyl succinimide)

The fusion protein and mPEG20K-NHS in a molar ratio of 1:1 was dissolved in a solution of 0.1 NN,N-Bis(2-hydroxyethyl) glycine (pH 8), with the protein concentration of 0.5 mg/mL. The reaction was run at room temperature for 2 hours and subjected to HPLC purification. Yield is approximately 90%.

2. Mercapto group (cysteine)

a) PEG-maleimide

The fusion protein and the equimolar amount of mPEG20K-maleimide were dissolved in PBS (NaCl 150 mM, phosphate 20 mM, pH 7.5) with a protein concentration of 3 mg/ml. The reaction was run at room temperature for 1 h and subjected to HPLC purification. Yield is approximately 90%.

b) PEG-iodoethylamide

The fusion protein (3 mg/ml) and PEG-iodoethylamide (1.5 equivalent) were dissolved in 50 mM Tris.HCl, 5 mM EDTA, pH 8.0 and reacted at room temperature in the dark for 90 minutes. The unreacted PEG reagent was removed by a D-Salt™ Dextran desalting column and the resultant was purified by HPLC.

With the above-mentioned method, fusion proteins were prepared on the basis of the GLP-1 receptor binding polypeptide—the interleukin-1 receptor antagonistic protein-PEG, and their molecular weights were determined with mass spectrometry as follows:

G-10: the calculated molecular weight value thereof is 41584.2 and a wide peak with an intermediate molecular weight of 41590.4 is determined by mass spectrometry, which is consistent with the compound shown in the instant application;

G-11: the calculated molecular weight value thereof is 41091.7 and a wide peak with an intermediate molecular weight of 41097.1 is determined by mass spectrometry, which is consistent with the compound shown in the instant application;

G-13: the calculated molecular weight value thereof is 40719.3 and a wide peak with an intermediate molecular weight of 40713.6 is determined by mass spectrometry, which is consistent with the compound shown in the instant application;

G-16: the calculated molecular weight value thereof is 41926.5 and a wide peak with an intermediate molecular weight of 41931.3 is determined by mass spectrometry, which is consistent with the compound shown in the instant application;

G-23: the calculated molecular weight value thereof is 40522.1 and a wide peak with an intermediate molecular weight of 40530.2 is determined by mass spectrometry, which is consistent with the compound shown in the instant application;

G-24: the calculated molecular weight value thereof is 40780.3 and a wide peak with an intermediate molecular weight of 40786.1 is determined by mass spectrometry, which is consistent with the compound shown in the instant application;

G-26: the calculated molecular weight value thereof is 41095.6 and a wide peak with an intermediate molecular weight of 41100.5 is determined by mass spectrometry, which is consistent with the compound shown in the instant application;

G-28: the calculated molecular weight value thereof is 41410.9 and a wide peak with an intermediate molecular weight of 41413.4 is determined by mass spectrometry, which is consistent with the compound shown in the instant application.

With the above-mentioned method, fusion proteins were prepared on the basis of the insulin receptor binding polypeptide—the interleukin-1 receptor antagonistic protein-PEG, and their molecular weights were determined with mass spectrometry as follows:

IN-27: the calculated molecular weight value thereof is 43939.9 and a wide peak with an intermediate molecular weight of 43947.8 is determined by mass spectrometry, which is consistent with the compound shown in the instant application.

G-52 synthesis

The IL-1ra and the equimolar amount of maleimide-PEG11-maleimide were dissolved in PBS with the polypeptide concentration of 5 mM. The reaction was run at room temperature for 1 h, and then the equimolar amount of HGEGTFTSDLSKQMEEEAVRLFIEWLKNGGPSSGA PPPC (SEQ ID NO: 185) was added. Two hours later, the reaction product was purified by HPLC with buffer A: 0.1% TFA aqueous solution, 10% acetonitrile and buffer B: 0.1% TFA aqueous solution, 80% acetonitrile. The calculated molecular weight value of the compound is 22176.9 and the molecular weight determined by mass spectrometry is 22186.7, with the sequencing result consistent with the sequence shown in the instant application.

With the above-mentioned method, fusion proteins were prepared on the basis of the GLP-1 receptor binding polypeptide-PEG—the interleukin-1 receptor antagonistic protein, and their molecular weights were determined with mass spectrometry as follows:

G-51: the calculated molecular weight value thereof is 22149.9 and the molecular weight determined by mass spectrometry is 22151.4, which is consistent with the compound shown in the instant application;

G-53: the calculated molecular weight value thereof is 21406.1 and the molecular weight determined by mass spectrometry is 21408.3, which is consistent with the compound shown in the instant application;

G-54: the calculated molecular weight value thereof is 21433.1 and the molecular weight determined by mass spectrometry is 21434.6, which is consistent with the compound shown in the instant application;

G-55: the calculated molecular weight value thereof is 21335.0 and the molecular weight determined by mass spectrometry is 21335.8, which is the compound shown in the instant application;

G-56: the calculated molecular weight value thereof is 21362.0 and the molecular weight determined by mass spectrometry is 21364.5, which is consistent with the compound shown in the instant application;

G-57: the calculated molecular weight value thereof is 22108.8 and the molecular weight determined by mass spectrometry is 22110.2, which is consistent with the compound shown in the instant application;

G-58: the calculated molecular weight value thereof is 22135.8 and the molecular weight determined by mass spectrometry is 22137.0, which is consistent with the compound shown in the instant application;

G-59: the calculated molecular weight value thereof is 41303.0 and a wide peak with an intermediate molecular weight of 41324.5 is determined by mass spectrometry, which is consistent with the compound shown in the instant application;

G-60: the calculated molecular weight value thereof is 41330.0 and a wide peak with an intermediate molecular weight of 41337.9 is determined by mass spectrometry, which is consistent with the compound shown in the instant application;

G-61: the calculated molecular weight value thereof is 40515.2 and a wide peak with an intermediate molecular weight of 40522.4 is determined by mass spectrometry, which is consistent with the compound shown in the instant application;

G-62: the calculated molecular weight value thereof is 40586.2 and a wide peak with an intermediate molecular weight of 40581.3 is determined by mass spectrometry, which is the compound shown in the instant application;

G-63: the calculated molecular weight value thereof is 40488.1 and a wide peak with an intermediate molecular weight of 40478.2 is determined by mass spectrometry, which is consistent with the compound shown in the instant application;

G-64: the calculated molecular weight value thereof is 40471.0 and a wide peak with an intermediate molecular weight of 40485.6 is determined by mass spectrometry, which is consistent with the compound shown in the instant application;

G-65: the calculated molecular weight value thereof is 41261.9 and a wide peak with an intermediate molecular weight of 41273.4 is determined by mass spectrometry, which is consistent with the compound shown in the instant application;

G-66: the calculated molecular weight value thereof is 41288.9 and a wide peak with an intermediate molecular weight of 41295.7 is determined by mass spectrometry, which is consistent with the compound shown in the instant application;

G-67: the calculated molecular weight value thereof is 41417.1 and a wide peak with an intermediate molecular weight of 41426.8 is determined by mass spectrometry, which is consistent with the compound shown in the instant application;

G-70: the calculated molecular weight value thereof is 40629.3 and a wide peak with an intermediate molecular weight of 40640.4 is determined by mass spectrometry, which is the compound shown in the instant application;

G-71: the calculated molecular weight value thereof is 21434.1 and the molecular weight determined by mass spectrometry is 21435.7, which is consistent with the compound shown in the instant application;

G-72: the calculated molecular weight value thereof is 21461.1 and the molecular weight determined by mass spectrometry is 21463.0, which is consistent with the compound shown in the instant application;

G-73: the calculated molecular weight value thereof is 21362.1 and the molecular weight determined by mass spectrometry is 21363.2, which is consistent with the compound shown in the instant application;

G-74: the calculated molecular weight value thereof is 21389.1 and the molecular weight determined by mass spectrometry is 21391.5, which is consistent with the compound shown in the instant application;

G-75: the calculated molecular weight value thereof is 21290.9 and the molecular weight determined by mass spectrometry is 21292.3, which is consistent with the compound shown in the instant application;

G-76: the calculated molecular weight value thereof is 21317.9 and the molecular weight determined by mass spectrometry is 21319.1, which is consistent with the compound shown in the instant application;

G-77: the calculated molecular weight value thereof is 21290.9 and the molecular weight determined by mass spectrometry is 21292.6, which is consistent with the compound shown in the instant application;

G-78: the calculated molecular weight value thereof is 21317.9 and the molecular weight determined by mass spectrometry is 21319.5, which is consistent with the compound shown in the instant application;

G-79: the calculated molecular weight value thereof is 21773.7 and the molecular weight determined by mass spectrometry is 21775.2, which is consistent with the compound shown in the instant application;

G-80: the calculated molecular weight value thereof is 21800.7 and the molecular weight determined by mass spectrometry is 21801.8, which is consistent with the compound shown in the instant application.

Synthesis of G-68

IL-1ra was dissolved in sodium phosphate to 1 mg/ml and the pH was adjusted to 5.0.2-fold equivalents of mPEG20K—CHO (whose structure is $CH_3O$—$(CH_2CH_2O)_n$—$(CH_2)_2$—CHO) was added, 45-fold equivalents of sodium cyanoborohydride was added to the concentration of 1 mM. The mixture was allowed to react at 4° C. for 12 hrs and purified by HPLC. The PEG20K IL-1ra and the equimolar amount of maleimide-PEG11-maleimide were dissolved in PBS with the polypeptide concentration of 5 mM. The reaction was run at room temperature for 1 h, and then the equimolar amount of HGEGTFTSDL SKQMEE EAVRLFIEWLKNGGPSSGAPPPC (SEQ ID NO: 185) was added. Two hours later, the reaction product was purified by HPLC with buffer A: 0.1% TFA aqueous solution, 10% acetonitrile and buffer B: 0.1% TFA aqueous solution, 80% acetonitrile. The calculated molecular weight value of the compound is 42176.9 and a wide peak with an intermediate molecular weight of 42193.4 is determined by mass spectrometry, which is consistent with the compound shown in the instant application;

G-69 was prepared in the same procedure.

G-69: the calculated molecular weight value thereof is 41406.1 and a wide peak with an intermediate molecular weight of 41424.5 is determined by mass spectrometry, which is consistent with the compound shown in the instant application.

With the above-mentioned method, fusion proteins were prepared on the basis of the GIP receptor binding polypeptide-PEG—the interleukin-1 receptor antagonistic protein, and their molecular weights were determined with mass spectrometry as follows:

GI-24: the calculated molecular weight value thereof is 23078.0 and the molecular weight determined by mass spectrometry is 23082.4, which is consistent with the compound shown in the instant application;

GI-25: the calculated molecular weight value thereof is 62255.1 and a wide peak with an intermediate molecular weight of 62283.5 is determined by mass spectrometry, which is consistent with the compound shown in the instant application;

GI-26: the calculated molecular weight value thereof is 62181.1 and a wide peak with an intermediate molecular weight of 62217.0 is determined by mass spectrometry, which is consistent with the compound shown in the instant application;

GI-27: the calculated molecular weight value thereof is 21712.5 and the molecular weight determined by mass spectrometry is 21714.6, which is consistent with the compound shown in the instant application;

GI-28: the calculated molecular weight value thereof is 23206.2 and the molecular weight determined by mass spectrometry is 23210.8, which is consistent with the compound shown in the instant application;

GI-29: the calculated molecular weight value thereof is 61598.4 and a wide peak with an intermediate molecular weight of 61567.3 is determined by mass spectrometry, which is consistent with the compound shown in the instant application;

GI-30: the calculated molecular weight value thereof is 21086.8 and the molecular weight determined by mass spectrometry is 21089.1, which is consistent with the compound shown in the instant application.

Synthesis of the Double Chain Insulin Receptor Binding Polypeptide

The document method (Han, et al., "Insulin chemical synthesis using a two-step orthogonal formation of the three disulfides", 21st American Peptide Society Symposium, 2009). The A chain and the B chain were synthesized by Fmoc or Boc chemistry synthesis. The cysteines at positions A7 and B7 were protected by a general protective group, while the mercapto groups on the side chains of the cysteines at positions A6, A11, A20, and B19 were protected by Acm. After being cleaved from the resin, the synthesized A and B chains were converted into A-(SH)$^7$ (S-Acm)$^{6,11,20}$ and B—(SH)$^7$ (S-Acm)$^{19}$. The B chain was dissolved in DMF or DMSO, and an equimolar amount of 2,2'-dithio-bis(5-nitropyridine) was added. The reaction was monitored and purified by HPLC, yielding B-(S-Npys)$^7$ (S-Acm)$^{19}$. The equimolar amount of A-(SH)$^7$ (S-Acm)$^{6,12}$ and B-(S-Npys)$^7$ (S-Acm)$^{19}$ were dissolved in DMSO with a polypeptide concentration of 15 mg/mL. When an A7-B7 disulfide bond was formed, 80% acetic acid aqueous solution was added and the polypeptide concentration was diluted to 1 mg/ml. Then, 40-fold amount of I$_2$ was added. The reaction was stirred at room temperature for 1 hour and then the ascorbic acid aqueous solution was added to stop the reaction. The mixture was purified by HPLC, and the final product was verified by mass spectrometry.

Synthesis of IN-29

FVNQHLC$_{[1]}$GSHLVEALYLVC$_{[2]}$GERGFFYTPRTGK-GSSSAAAPQTGIVEQC$_{[3]}$C$_{[4]}$TSIC$_{[5]}$SLYQLENYC$_{[6]}$N (SEQ ID NO:283) ([1] to [6] indicates the No. of the cysteines; 3 pairs of disulfide bonds are formed by six cysteines in the compound, the specific positions for the three pairs of disulfide bonds are: C$_{[1]}$ and C$_{[4]}$ forming a disulfide bond, C$_{[2]}$ and C$_{[6]}$ forming a disulfide bond, C$_{[3]}$ and C$_{[5]}$ forming a disulfide bond) (68 mg) was dissolved in NH$_4$HCO$_3$ (15 mL, pH 9), Mal-dPEG12-NHS (10 mg) was added and stirred at room temperature for 30 min. Then, IL-1Ra (175 mg) was added and the reaction was further stirred at room temperature for 1 h. The sample was purified by HPLC, with buffer A: 0.1% TFA aqueous solution, 10% acetonitrile and buffer B: 0.1% TFA aqueous solution, 80% acetonitrile. The calculated molecular weight value of the compound is 24737.9 and the molecular weight determined by mass spectrometry is 24739.6. The sequencing result is consistent with the sequence shown in the instant application.

Synthesis of A1, B29-diBoc-insulin

Human insulin (100 mg) was dissolved in water (1 mL), NaHCO$_3$ (0.3 mL), and DMF (3 mL). t-Boc-azide (6 mg) was added. The mixture was stirred at 40° C. for 3 hours and 50% acetic acid (0.35 mL) was added to stop the reaction. The unreacted t-Boc-azide was extracted with ethyl ether (2×15 mL). The aqueous layer was freeze-dried under vacuum. The crude product comprised the insulin mono-, bi-, and tri-substituted with Boc. The mixture was purified with a SP-Sephadex C-25 ion exchange column. The ion exchange column was firstly equilibrated with 1.5 M acetic acid containing 6 M urea, the elution rate for the polypeptide is a 48 mL/h, with a linear gradient of 0.04-0.4 M sodium chloride/1000 mL of 1.5 M acetic acid containing 6 M urea. Di-t-Boc insulin was purified further with a DEAE-Sephadex A-25 column. The chromatographic column was equilibrated previously with 0.01 M Tris buffer (pH 8.5) containing 7 M urea. The elution rate was 35 mL/h, with a gradient of 0.14-0.28 M sodium chloride/100 mL of Tris buffer. The calculated molecular weight value thereof is 6007.9 and the molecular weight determined by mass spectrometry is 6009.2. A small amount of the polypeptide was dissolved in 0.05M NH$_4$HCO$_3$/20% ACN and reduced with DTT for 10 min, following mass spectrometric analysis. A(G1-N$^\alpha$-Boc): the calculated molecular weight value thereof is 2483.9 and the molecular weight determined by mass spectrometry is 2485.1.B (K29-N-$^\epsilon$-Boc): the calculated molecular weight value thereof is 3530.1 and the molecular weight determined by mass spectrometry is 3532.5. After trypsin digestion, the calculated molecular weight value of the fragment not comprising Boc is 2487.9 and the molecular weight thereof determined by mass spectrometry is 2488.7; while the calculated molecular weight value of the fragment comprising Boc is 1060.2 and the molecular weight thereof determined by mass spectrometry is 1061.3. The amino group at the B1 in the A1, B29-di-Boc polypeptide can be attached to polyethylene glycol, an albumin, a fatty acid, etc. to form a long-lasting polypeptide.

Synthesis of IN-35

A1, B29-diBoc-insulin (60 mg) was dissolved in DMF (3 mL), then Mal-dPEG12-NHS (9 mg) and triethylamine (30 μL) were added. The reaction was stirred for 2 hours at room temperature. After the solvent was evaporated under a reduced pressure, the crude product was dissolved in H$_2$O/CAN (3:1) and purified by RP-HPLC. The calculated molecular weight value thereof is 6758.8 and the molecular weight determined by mass spectrometry is 6760.4. The maleimide-diBoc-insulin was dissolved in purified water, with a polypeptide concentration of 10 mM. IL-1Ra (172 mg) was added and incubated at 37° C. for 30 min. Then, the resultant solution was diluted with a solution of 20 mM sodium phosphate containing 5 mM sodium octanoate and 750 mM ammonium sulphate. The unreacted reagents were removed by gel filtration chromatography, using 0.05 M ammonium bicarbonate aqueous solution as the elution solution. The pure product was obtained after freeze-dry in vacuum. The calculated molecular weight value of the obtained compound is 23884.2 and the molecular weight determined by mass spectrometry is 23886.7. The compound was assayed to be Di-Boc IN-35. Di-Boc IN-35 was dissolved in TFA/TIS (95:5) (3 mL) and stirred at room temperature for 15 min, the solvent was removed under a reduced pressure, and the crude product was purified by RP-HPLC with buffer A: 0.1% TFA aqueous solution, 10% acetonitrile and buffer B: 0.1% TFA aqueous solution, 80% acetonitrile. The calculated molecular weight value of the final compound is 23684.9 and the molecular weight determined by mass spectrometry is 23887.5, and was assayed to be IN-35.

With the above-mentioned method, fusion proteins were prepared on the basis of the insulin receptor binding polypeptide—the interleukin-1 receptor antagonistic protein -PEG, and their molecular weights were determined with mass spectrometry as follows:

IN-30: the calculated molecular weight value thereof is 24710.9 and the molecular weight determined by mass spectrometry is 24712.3, which is consistent with the compound shown in the instant application;

IN-31: the calculated molecular weight value thereof is 43987.1 and a wide peak with an intermediate molecular weight of 43993.5 is determined by mass spectrometry, which is consistent with the compound shown in the instant application;

IN-32: the calculated molecular weight value thereof is 43960.1 and a wide peak with an intermediate molecular weight of 43972.6 is determined by mass spectrometry, which is consistent with the compound shown in the instant application;

IN-35: the calculated molecular weight value thereof is 23684.9 and the molecular weight determined by mass spectrometry is 23685.2, which is consistent with the compound shown in the instant application;

IN-36: the calculated molecular weight value thereof is 23981.3 and the molecular weight determined by mass spectrometry is 23983.4, which is consistent with the compound shown in the instant application;

IN-37: the calculated molecular weight value thereof is 42934.1 and a wide peak with an intermediate molecular weight of 42945.8 is determined by mass spectrometry, which is consistent with the compound shown in the instant application;

IN-38: the calculated molecular weight value thereof is 23657.9 and the molecular weight determined by mass spectrometry is 23659.0, which is consistent with the compound shown in the instant application;

IN-39: the calculated molecular weight value thereof is 42907.1 and a wide peak with an intermediate molecular weight of 42915.6 is determined by mass spectrometry, which is consistent with the compound shown in the instant application;

IN-40: the calculated molecular weight value thereof is 23954.3 and the molecular weight determined by mass spectrometry is 23957.1, which is consistent with the compound shown in the instant application;

IN-41: the calculated molecular weight value thereof is 23583.8 and the molecular weight determined by mass spectrometry is 23585.6, which is consistent with the compound shown in the instant application;

IN-42: the calculated molecular weight value thereof is 42833.0 and a wide peak with an intermediate molecular weight of 42834.4 is determined by mass spectrometry, which is consistent with the compound shown in the instant application;

IN-43: the calculated molecular weight value thereof is 23556.8 and the molecular weight determined by mass spectrometry is 23559.2, which is consistent with the compound shown in the instant application;

IN-44: the calculated molecular weight value thereof is 42806.0 and a wide peak with an intermediate molecular weight of 42812.5 is determined by mass spectrometry, which is consistent with the compound shown in the instant application;

IN-45: the calculated molecular weight value thereof is 24825.0 and the molecular weight determined by mass spectrometry is 24826.8, which is consistent with the compound shown in the instant application;

IN-46: the calculated molecular weight value thereof is 44074.2 and a wide peak with an intermediate molecular weight of 44083.1 is determined by mass spectrometry, which is consistent with the compound shown in the instant application;

IN-47: the calculated molecular weight value thereof is 24798.0 and the molecular weight determined by mass spectrometry is 24799.3, which is consistent with the compound shown in the instant application;

IN-48: the calculated molecular weight value thereof is 44047.2 and a wide peak with an intermediate molecular weight of 44056.9 is determined by mass spectrometry, which is consistent with the compound shown in the instant application;

IN-49: the calculated molecular weight value thereof is 24783.9 and the molecular weight determined by mass spectrometry is 24785.7, which is consistent with the compound shown in the instant application;

IN-50: the calculated molecular weight value thereof is 44033.1 and a wide peak with an intermediate molecular weight of 44026.3 is determined by mass spectrometry, which is consistent with the compound shown in the instant application;

IN-51: the calculated molecular weight value thereof is 24825.0 and the molecular weight determined by mass spectrometry is 24827.5, which is consistent with the compound shown in the instant application;

IN-52: the calculated molecular weight value thereof is 44074.2 and a wide peak with an intermediate molecular weight of 44081.6 is determined by mass spectrometry, which is consistent with the compound shown in the instant application;

IN-53: the calculated molecular weight value thereof is 24841.0 and the molecular weight determined by mass spectrometry is 24843.1, which is consistent with the compound shown in the instant application;

IN-54: the calculated molecular weight value thereof is 44090.2 and a wide peak with an intermediate molecular weight of 44098.0 is determined by mass spectrometry, which is consistent with the compound shown in the instant application;

IN-55: the calculated molecular weight value thereof is 24135.3 and the molecular weight determined by mass spectrometry is 24139.2, which is consistent with the compound shown in the instant application;

IN-56: the calculated molecular weight value thereof is 24108.3 and the molecular weight determined by mass spectrometry is 24117.5, which is consistent with the compound shown in the instant application;

IN-57: the calculated molecular weight value thereof is 23772.0 and the molecular weight determined by mass spectrometry is 23773.9, which is consistent with the compound shown in the instant application;

IN-58: the calculated molecular weight value thereof is 24068.4 and the molecular weight determined by mass spectrometry is 24070.7, which is consistent with the compound shown in the instant application;

IN-59: the calculated molecular weight value thereof is 23670.9 and the molecular weight determined by mass spectrometry is 23672.8, which is consistent with the compound shown in the instant application;

IN-60: the calculated molecular weight value thereof is 23903.2 and the molecular weight determined by mass spectrometry is 23891.3, which is consistent with the compound shown in the instant application;

IN-61: the calculated molecular weight value thereof is 23802.1, and the molecular weight determined by mass spectrum is 23812.6, which is consistent with the compound shown in the instant application.

Receptor Competitive Binding Assay

1. Receptor Binding Assay for IL-1Ra

Reference was made to "Interleukin-1 receptor antagonist activity of a human interleukin-1 inhibitor", Hannum et al, Nature 343, 336-340). Briefly, a standard amount of $^{35}$S-labeled IL-1Ra with a specific activity of 4000 Ci/mmol was added to a 96-well plate to reach a final concentration which approximately equals to its $K_d$ (150 pM). Murine EL4 thymoma cells (ATCC, TIB181, about 5000 receptors per cell) or Chinese hamster ovary (CHO)-derived cells expressing human IL-1 receptor (about 30,000 receptors per cell) and the fusion protein of different concentrations (diluted in series from 20 mM to 20 pM) were cultured at 4° C. for 4 hours. The cells were harvested through a Millipore millititer plate filter system, and radioactivity retained on the filter membrane was counted by an Ambis radioanalytical imaging system. Percentage of wild type activity was defined as $IC_{50}$ (wild type)/$IC_{50}$ (fusion protein). The $K_d$ for wild type IL-1ra was estimated using a simplification mode of the Cheng-Prusoff relationship ($K_d=IC_{50}/2$) and ranged from 150 to 400 pM, consistent with the values previously reported in publications.

2. Receptor Binding Assay for Insulin (1) Preparation of $^{125}$I-insulin

According to the document method (Cresto, et al., "Preparation of biologically active mono-$^{125}$I-insulin of high specific activity." Acta Physiol Lat Am. 1981, 31(1):13-24)

(2) Receptor Binding Assay for the Compound

According to the document method (E. K. Frandsen and R. A. Bacchus. "New, simple insulin-receptor assay with universal application to solubilized insulin receptors and receptors in broken and intact cells." Diabetes, 1987, 36, 3:335-340) or one of the following methods. Unless otherwise stated, the method of preparing receptor was the same as the literature method, using human placenta membrane. Typically, 0.025 mg of placenta membrane was used in insulin receptor binding assay.

In the insulin receptor binding assay, the starting standard concentrations of both the insulin and the fusion proteins of the present invention were 100 nM, and the insulin and the fusion proteins were 3-fold diluted serially, resulting in the solutions with seven different concentrations (100 nM, 33.33 nM, 11.11 nM, 3.70 nM, 1.23 nM, 0.41 nM, 0.13 nM, and 0.04 nM). For the fusion proteins having an activity for the insulin receptor lower than 10% of human insulin standard, the starting concentration of the proteins was 500 nM.

Truncated Water-Soluble Receptors

Insulin receptor, $^{125}$I-insulin (3 pM) and a series of fusion proteins diluted 3-fold were added toa buffer [100 mM Hepes, pH 8.0, 100 mM NaCl, 10 mM MgCl$_2$, 0.5% (w/v) BSA, 0.025% (w/v) Triton X-100] to reach a total volume of 200 μL, incubated for 48h at 4° C. Subsequently, the receptor and fusion proteins and ligand bound to the receptor were precipitated with 0.2% γ-globulin and 500 μL of 25% (w/v) PEG 8000, and the radioactivity in the precipitate was determined. The concentration of the receptor was adjusted to a concentration at which 15-20% of receptor binds to the ligand when no fusion proteins was added.

Membrane-Bound Receptors

Membrane-bound receptors used in receptor binding assays were from BHK cells overexpressing full-length insulin receptors. Equal number of transfected BHK cells (2000-5000) was evenly seeded in each well of a 96-well plate and grown for 24 h in Dulbecco's modified Eagle's medium (DMEM) containing 10% (v/v) fetal bovine serum before performing the receptor binding assay. Cells were firstly washed once with binding buffer (DMEM containing 0.50% BSA, 20 mM Hepes, pH 7.8), then $^{125}$I-insulin (6.5 pM) and a series of fusion proteins diluted 3-foldin binding buffer were added. Cultured for 3 h at 16° C. and unbound polypeptides were sucked out using a sucker, and washed once with 1.2 ml of binding buffer. Cells were solubilized in 500 μl of 1% (w/v) SDS, 100 mM NaCl, 25 mM Hepes (pH 7.8) and detected. The number of cells was adjusted to a number of which 16-28% of receptor binds to the ligand when no fusion proteins was added.

Insulin Receptor: $^{125}$I-Insulin (30 nCi), a series of fusion proteins diluted 3-fold and placental membranes (0.025 mg) were incubated in 0.05 ml of buffer described above for 1 h at 20° C. Samples were filtered with EHWP filters, and the incubation tubes and filters were washed four times with 2.5 ml of cold buffer free of bovine albumin. Less than 5% of the fusion proteins were attached to the filters in the absence of placental membranes. Nonspecific binding of ligand to placental membranes was measured by adding excess amount of non-iodonation insulin (1 μM) to the incubation mixture. Nonspecific binding usually accounts for less of 1% of the total binding of ligand to placental membranes.

Specific binding percentage=(binding radioactivity-nonspecific binding radioactivity/total binding radioactivity-nonspecific binding radioactivity)×100. Total binding radioactivity is the total radioactivity detected before addition of fusion proteins and binding radioactivity is the radioactivity detected after addition of fusion proteins. $IC_{50}$ of fusion proteins was calculated using Origin software (OriginLab, Northampton, Mass.). Activity of fusion protein relative to human insulin standard=$IC_{50}$ human insulin standard/$IC_{50}$ fusion protein.

3. GLP-1cAMP Assay

BHK (baby hamster kidney) cells expressing the GLP-1 receptor of human pancreatic islet were prepared according to the literature (Knudsen and Pridal, 1996, Eur. J. Pharm. 318, 429-435). The plasma membrane was prepared according to the literature (Adelhorst, et al., 1994, J. Biol. Chem. 269, 6275), homogenized in a buffer (10 mmol/l Tris-HCl, 30 mmol/l NaCl, pH 7.4, 1 mmol DTT, 5 mg/l leupeptin, 5 mg/l pepstatin, 100 mg/l bacitracin, 16 mg/l aprotinin). The homogeneous mixture was centrifuged over a layer of 41 w/v % sucrose. The white zone between the upper and lower layers was dissolved in a buffer and centrifuged. The plasma membrane was stored at −80° C.

A 96-well microtiter plate was used in the analysis assay, with a total volume of 140 μl. The buffer contained 50 mmol/l Tris-HCl, pH 7.4, 1 mmol/l EGTA, 1.5 mmol/l MgSO$_4$, 1.7 mmol/l ATP, 20 mM GTP, 2 mmol/l, 3-isobutyl-1-methylxanthine, 0.01% Tween-20, 0.1% human serum albumin. The tested sample was dissolved and diluted with the buffer, and added to the membrane preparation. The mixture was incubated at 37° C. for 2 hours. The reaction was stopped by adding 25 µl of 0.05 mol/l HCl. After 10-fold diluted, the samples was measured with scintillation proximity assay (SPA) for cAMP. For references, see Kahl, et al., "Scintillation Proximity Assay." February, 2005. DOI: 10.1002/0471142301.ns0715s30. http://www.currentprotocols.com/WileyCDA/CPUnit/refld-ns0715.html. EC$_{50}$ for the GLP-1 (7-37) standard was 61 pM.

4. GIP cAMP Assay

The assay was done as described in the publication (Wheeler et al, "Characterization of the carboxyl-terminal domain of the rat glucose-dependent insulinotropic polypeptide (GIP) receptor: a role for serines 426 and 427 in internalization" J. Biol. Chem. 1999, 274: 24593-24601). CHO cells stably expressing GIP receptors were transferred to a 96-well microtiter plate, incubated for 48 hours. The cells were washed with a 37° C. analytic buffer buffered by HEPES (DMEM/F12, 15 mM HEPES (Sigma-Aldrich), 0.1% bovine albumin (Sigma-Aldrich), pH 7.4), pre-incubated for 60 minutes. The samples (0.001-100 nM fusion protein dissolved in 10 mM HEPES, pH 7.4, 150 mM NaCl, 5 mM KCl, 2.5 mM CaCl$_2$, 1.2 mM KH$_2$PO$_4$, 1.2 mM MgSO$_4$, 25 mM NaHCO$_3$, 0.5 mM3-isobutyl-1-methylxanthine, and 1%(w/v) bovine albumin) were added to the cells, and cultured for 30 minutes. For GIP receptor antagonists, cells were first incubated with the antagonists for 15 min, then 1 nM GIP(1-42) was added and cultured for 30 minutes. The amount of cAMP was measured with scintillation proximity assay.

5. GIP Receptor Binding Assay

GIP (5 µg) was iodinated by the traditional chloramine-T method and purified with C-18 column (Sep-Pak; Millipore Corp.), the gradient of acetonitrile was 30-45%. Specific activity of radioactively labeled GIP ranged from 10 to 50 µCi/mg. $^{125}$I-GIP was dissolved in analytical buffer with a concentration of 3×10$^5$ cpm/100 µl. CHO cells expressing GIP receptors (1-5×10$^5$/well) were washed twice with the binding buffer (DMEM/F12, 20 mm HEPES, 0.1% bovine albumin, 0.5 mg/ml bacitracin, pH 7.4). $^{125}$I-GIP (50000 cpm) and 0.3-500 nM fusion protein were added, and incubated for 12-16h at 4° C. $^{125}$I-GIP unbound to the receptor was separated in vacuum. The microtiter plate were washed with ice cold PBS containing 0.1% (w/v) bovine albumin and dried at room temperature. 30 µl Ultima Gold (Perkin-Elmer) could be added according to the actual conditions, $^{125}$I-GIP content was measured by a gamma-ray counter. IC$_{50}$ calculation method is the same as that in the insulin receptor binding assay. IC$_{50}$ of GIP (1-42) standard was 2.1±0.75 nM.

Experimental Results:

The biological activity of the compounds of the present invention was detected by performing GLP-1 receptor binding capability, insulin receptor binding capability, GIP receptor binding capability, and interleukin-1 receptor binding capability assays on these compounds, using the human GLP-1 (7-37) as the reference for the GLP-1 receptor binding capacity (100%), the human insulin as the reference for the insulin receptor binding capacity (100%), the GIP (1-42) as the reference for the GIP receptor binding capacity (100%), and the wild-type human IL-1Ra as the reference for the interleukin-1 receptor antagonistic protein (100%). The obtained results were shown in Tables 1, 2, and 3, respectively.

TABLE 1

The biological activity of the fusion protein of the GLP-1 receptor binding polypeptide and the interleukin-1 receptor antagonistic protein

| No. | GLP-1 receptor (%) | Il-1ra receptor (%) |
| --- | --- | --- |
| G-1 | 52 | 33 |
| G-2 | 53 | 40 |
| G-3 | 61 | 46 |
| G-4 | 67 | 45 |
| G-5 | 45 | 37 |
| G-6 | 49 | 48 |
| G-7 | 50 | 51 |
| G-8 | 48 | 53 |
| G-9 | 30 | 26 |
| G-10 | 29 | 30 |
| G-11 | 21 | 33 |
| G-12 | 22 | 34 |
| G-13 | 19 | 31 |
| G-14 | 20 | 32 |
| G-15 | 17 | 26 |
| G-16 | 25 | 33 |
| G-17 | 20 | 32 |
| G-18 | 42 | 31 |
| G-19 | 43 | 38 |
| G-20 | 55 | 46 |
| G-21 | 58 | 45 |
| G-22 | 60 | 47 |
| G-23 | 27 | 24 |
| G-24 | 32 | 27 |
| G-25 | 33 | 29 |
| G-26 | 26 | 30 |
| G-27 | 24 | 32 |
| G-28 | 23 | 35 |
| G-29 | 43 | 34 |
| G-30 | 57 | 42 |
| G-31 | 53 | 40 |
| G-32 | 62 | 41 |
| G-33 | 54 | 43 |
| G-34 | 46 | 42 |
| G-35 | 53 | 40 |
| G-36 | 60 | 44 |
| G-37 | 63 | 46 |
| G-38 | 61 | 43 |
| G-39 | 62 | 42 |
| G-40 | 51 | 45 |
| G-41 | 46 | 41 |
| G-42 | 45 | 42 |
| G-43 | 41 | 40 |
| G-44 | 40 | 40 |
| G-45 | 46 | 42 |
| G-46 | 45 | 43 |
| G-47 | 42 | 41 |
| G-48 | 42 | 40 |
| G-49 | 43 | 42 |
| G-50 | 44 | 43 |
| G-51 | 92 | 47 |
| G-52 | 90 | 46 |
| G-53 | 79 | 46 |
| G-54 | 78 | 47 |
| G-55 | 72 | 45 |
| G-56 | 70 | 44 |
| G-57 | 83 | 45 |
| G-58 | 82 | 43 |
| G-59 | 81 | 39 |
| G-60 | 80 | 37 |
| G-61 | 75 | 38 |
| G-62 | 73 | 36 |
| G-63 | 71 | 37 |
| G-64 | 70 | 34 |
| G-65 | 77 | 36 |
| G-66 | 76 | 35 |
| G-67 | 52 | 35 |
| G-68 | 51 | 33 |
| G-69 | 45 | 34 |
| G-70 | 42 | 32 |
| G-71 | 78 | 46 |
| G-72 | 77 | 47 |

TABLE 1-continued

The biological activity of the fusion protein of the GLP-1 receptor binding polypeptide and the interleukin-1 receptor antagonistic protein

| No. | GLP-1 receptor (%) | Il-1ra receptor (%) |
|---|---|---|
| G-73 | 78 | 46 |
| G-74 | 76 | 45 |
| G-75 | 71 | 46 |
| G-76 | 70 | 43 |
| G-77 | 82 | 44 |
| G-78 | 81 | 42 |
| G-79 | 120 | 40 |
| G-80 | 115 | 39 |
| G-81 | 39 | 12 |
| G-82 | 7 | 12 |
| G-83 | 37 | 8 |
| G-84 | 15 | 9 |

TABLE 2

The biological activity of the fusion protein of the insulin receptor binding polypeptide and the interleukin-1 receptor antagonistic protein

| No. | Insulin receptor (%) | IL-1 receptor |
|---|---|---|
| IN-1 | 17 | 35 |
| IN-2 | 17 | 34 |
| IN-3 | 16 | 35 |
| IN-4 | 20 | 39 |
| IN-5 | 20 | 38 |
| IN-6 | 18 | 37 |
| IN-7 | 25 | 49 |
| IN-8 | 25 | 47 |
| IN-9 | 24 | 47 |
| IN-10 | 26 | 50 |
| IN-11 | 25 | 48 |
| IN-12 | 25 | 48 |
| IN-13 | 13 | 34 |
| IN-14 | 12 | 32 |
| IN-15 | 12 | 32 |
| IN-16 | 18 | 42 |
| IN-17 | 18 | 40 |
| IN-18 | 17 | 40 |
| IN-19 | 23 | 47 |
| IN-20 | 23 | 44 |
| IN-21 | 21 | 43 |
| IN-22 | 25 | 46 |
| IN-23 | 25 | 46 |
| IN-24 | 24 | 45 |
| IN-25 | 19 | 38 |
| IN-26 | 18 | 39 |
| IN-27 | 10 | 31 |
| IN-28 | 9 | 29 |
| IN-29 | 53 | 45 |
| IN-30 | 53 | 42 |
| IN-31 | 9 | 33 |
| IN-32 | 9 | 31 |
| IN-33 | 16 | 40 |
| IN-34 | 15 | 44 |
| IN-35 | 19 | 45 |
| IN-36 | 10 | 34 |
| IN-37 | 14 | 30 |
| IN-38 | 50 | 47 |
| IN-39 | 14 | 33 |
| IN-40 | 12 | 35 |
| IN-41 | 47 | 46 |
| IN-42 | 13 | 31 |
| IN-43 | 45 | 43 |
| IN-44 | 11 | 32 |
| IN-45 | 20 | 39 |
| IN-46 | 10 | 28 |

TABLE 2-continued

The biological activity of the fusion protein of the insulin receptor binding polypeptide and the interleukin-1 receptor antagonistic protein

| No. | Insulin receptor (%) | IL-1 receptor |
|---|---|---|
| IN-47 | 19 | 38 |
| IN-48 | 9 | 26 |
| IN-49 | 27 | 25 |
| IN-50 | 16 | 20 |
| IN-51 | 49 | 37 |
| IN-52 | 8 | 19 |
| IN-53 | 47 | 36 |
| IN-54 | 9 | 18 |
| IN-55 | 38 | 35 |
| IN-56 | 38 | 36 |
| IN-57 | 20 | 23 |
| IN-58 | 7 | 17 |
| IN-59 | 21 | 19 |
| IN-60 | 21 | 24 |
| IN-61 | 23 | 22 |
| IN-62 | 18 | 47 |
| IN-63 | 17 | 45 |
| IN-64 | 20 | 42 |
| IN-65 | 17 | 43 |
| IN-66 | 15 | 41 |
| IN-67 | 11 | 46 |
| IN-68 | 5 | 10 |
| IN-69 | 7 | 18 |
| IN-70 | 8 | 42 |

TABLE 3

The biological activity of the fusion protein of the GIP receptor binding polypeptide and the interleukin-1 receptor antagonistic protein

| No. | GIP receptor (%) | IL-1 receptor (%) |
|---|---|---|
| GI-1 | 53 | 46 |
| GI-2 | 264 | 47 |
| GI-3 | 298 | 44 |
| GI-4 | 312 | 45 |
| GI-5 | 316 | 42 |
| GI-6 | (50) | 48 |
| GI-7 | (53) | 45 |
| GI-8 | (55) | 43 |
| GI-9 | (55) | 40 |
| GI-10 | (6.2) | 42 |
| GI-11 | 187 | 38 |
| GI-12 | 179 | 41 |
| GI-13 | 356 | 39 |
| GI-14 | 368 | 40 |
| GI-15 | 381 | 45 |
| GI-16 | (57) | 43 |
| GI-17 | (61) | 47 |
| GI-18 | (72) | 46 |
| GI-19 | (54) | 50 |
| GI-20 | (65) | 48 |
| GI-21 | (63) | 45 |
| GI-22 | 36 | 21 |
| GI-23 | (28) | 19 |
| GI-24 | 137 | 50 |
| GI-25 | 24 | 18 |
| GI-26 | (19) | 23 |
| GI-27 | 42 | 67 |
| GI-28 | 79 | 51 |
| GI-29 | 156 | 24 |
| GI-30 | (49) | 58 |

Note:
The cAMP assay was used for analysis of GI-1 to GI-5, GI-11 to GI-15, GI-22, GI-24, GI-25, and GI-27 to GI-29 in the tables. The GIP receptor binding assay was used for analysis of other proteins, wherein the ratio of the activity of the proteins vs. GIP (1-42) in the GIP receptor binding assay was shown in the parenthesis. These proteins are inhibitors to the GIP receptor. Accordingly, the receptor binding assay was used instead of the cAMP assay.

Animal Test

1. The 5 week-old C57BL/6J mice was fed high-fat/high-sucrose feedstuff (in which 58% of calories came from fat, 26% from carbohydrate, and 16% from protein). The mice were assigned into four groups, six animals per group. The mice in Group 1 were intraperitoneally injected daily with the physiological saline (0.9% w/v, NaCl), the mice in Group 2 were injected daily with IL-1Ra (500 nmol/kg), and the mice in Groups 3 and 4 were injected daily with the fusion proteins G-2 and G-20 (50 nmol/kg), for 12 consecutive weeks, followed by a glucose tolerance test. The mice were first fasted for 12 hours and then intraperitoneally injected with glucose (2 mg/g). Blood was collected at 0, 15, 30, 60, 90, 120 min respectively and the blood glucose was measured. Furthermore, the levels of serum insulin were measured at 0 and 30 min respectively.

Figure 7:
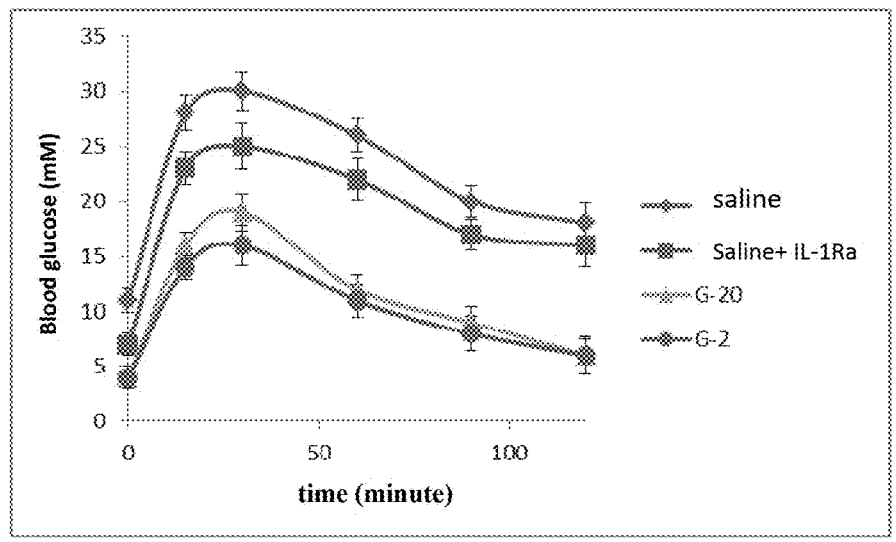
FIG. 7 is the analysis of the blood glucose in an animal test. Four groups of mice were treated with saline, the interleukin-1 receptor antagonist, the fusion proteins G-2 and G-20 (two representative fusion proteins of the GLP-1 receptor binding polypeptide—linking group—the interleukin-1 receptor antagonistic protein) respectively for 12 weeks, and then examined for the change of blood glucose in a glucose tolerance test.

In the test shown in FIG. 7, better blood glucose control was demonstrated in the IL-1Ra group as compared with that in the physiological saline group. Furthermore, the glucose tolerance in the mice of G-2 and G-20 groups was markedly enhanced, with a low peak of blood glucose and a rapid decrease of the blood glucose level. During 12 weeks of treatment, dosages of the G-2 and G-20 were only ⅒ of the dosage of IL-1Ra, demonstrating that the fusion protein of the GLP-1 receptor binding polypeptide and the interleukin-1 receptor antagonistic protein has an in vivo biological activity and a therapeutic effect significantly superior to those of the IL-1Ra.

Figure 8:
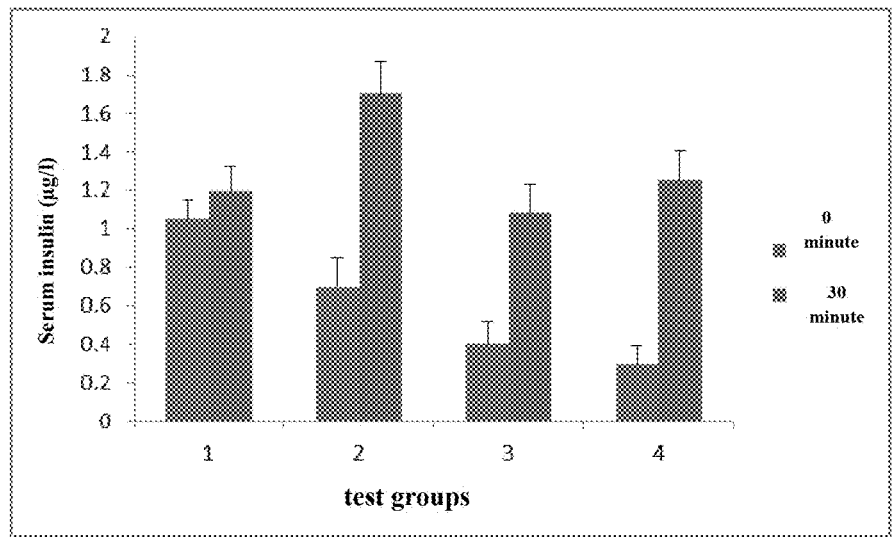
FIG. 8 is the analysis of insulin level in an animal test. Four groups of mice were treated with saline (1 in the figure), the interleukin-1 receptor antagonist (2 in the figure), G-20 (3 in the figure) and G-2 (4 in the figure) (two representative fusion proteins of the GLP-1 receptor binding polypeptide—linking group—the interleukin-1 receptor antagonistic protein) for 12 weeks, and then examined for the change of insulin level in a glucose tolerance test.

In the test shown in FIG. 8, the fasting serum insulin level in the IL-1Ra group was significantly lower than that in the physiological saline group. The insulin level in the physiological saline group varied minimally during the glucose tolerance test, while the insulin level in the IL-1Ra group was 2-fold higher than that of fasting period. The fasting serum insulin levels in the G-2 and G-20 groups were lowest, while the insulin levels during the glucose tolerance test were 2.5 to 4-fold higher than those of fasting period, suggested that the G-2 and G-20 have better regulation and protection on the function of pancreatic islet than IL-1Ra alone used. Better blood glucose control was demonstrated.

2. The 5 week-old C57BL/6J mice was fed high-fat/high-sucrose feedstuff (in which 58% of calories came from fat, 26% from carbohydrate, and 16% from protein). The mice were assigned into four groups, six animals per group. The mice in Group 1 (the control group) were intraperitoneally injected daily with the physiological saline (0.9% w/v, NaCl), the mice in Group 2 were injected daily with IL-1Ra (500 nmol/kg), and the mice in Groups 3 and 4 were injected daily with the fusion proteins IN-7 and IN-62 (30 nmol/kg) after a meal, for 12 consecutive weeks, followed by an insulin tolerance test. The mice were first fasted for 5 hours and then intraperitoneally injected with human insulin (0.75 U/kg). Blood was collected at 0, 15, 30, 60, 90, 120 min and the blood glucose was measured respectively.

Figure 9:
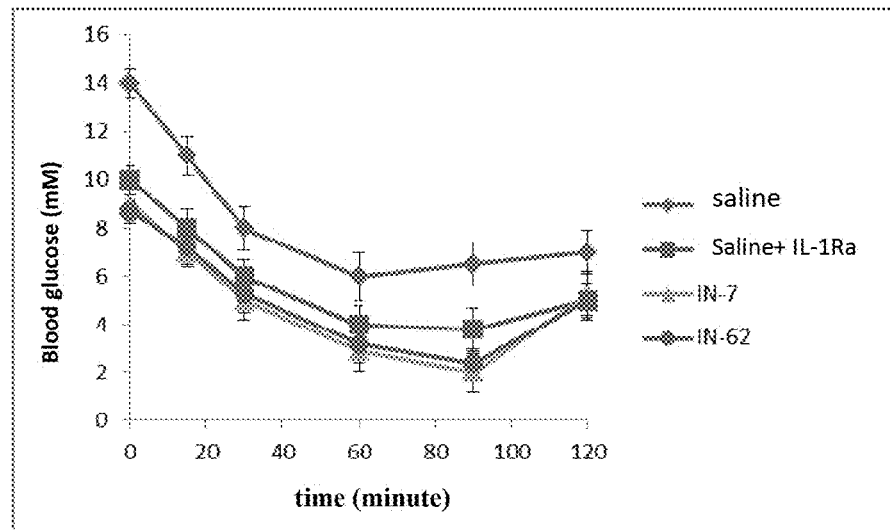
FIG. 9 is the analysis of the blood glucose in an animal test. Four groups of mice were treated with saline, the interleukin-1 receptor antagonist, the fusion proteins IN-7 and IN-62 (two representative fusion proteins of the insulin receptor binding polypeptide—linking group—the interleukin-1 receptor antagonistic protein) for 12 weeks, and then examined for the change of blood glucose in an insulin tolerance test.

The high-fat food often leads to hyperinsulinemia, resulting in a decreased sensitivity to the insulin, which is the etiologic cause in a substantial proportion of obese patients with type 2 diabetes. Increasing the insulin sensitivity is one of important methods to prevent or even treat diabetes. In the test shown in FIG. 9, better insulin sensitivity was demonstrated in the IL-1Ra group as compared with that in the physiological saline group. The insulin sensitivity of the mice in the IN-7 and IN-62 groups was more superior. During 12 weeks of treatment, dosages of the IN-7 and IN-62 were only 1/17 of the dosage of IL-1Ra, demonstrating that the fusion protein of the insulin receptor binding polypeptide and the interleukin-1 receptor antagonistic protein has an in vivo biological activity and a therapeutic effect significantly superior to those of the IL-1Ra.

3. The 5 week-old C57BL/6J mice was fed high-fat/high-sucrose feedstuff (in which 58% of calories came from fat, 26% from carbohydrate, and 16% from protein). The mice were assigned into four groups, six animals per group. The mice in Group 1 (the control group) were intraperitoneally injected daily with the physiological saline (0.9% w/v, NaCl), the mice in Group 2 were injected daily with IL-1Ra (500 nmol/kg), and the mice in Groups 3 and 4 were injected daily with the fusion proteins GI-3 and GI-7 (50 nmol/kg), for 12 consecutive weeks, followed by the glucose tolerance test. The mice were first fasted for 12 hours and then intraperitoneally injected with glucose (2 mg/g). Blood was collected at 0, 15, 30, 60 min and the blood glucose was measured respectively.

Figure 10:
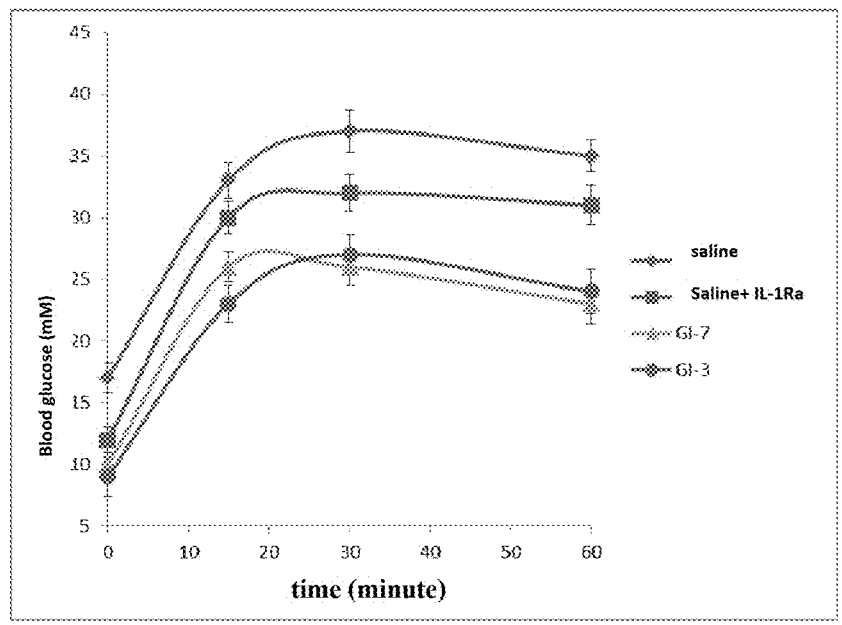
FIG. 10 is the analysis of blood glucose in an animal test. Four groups of mice were treated with saline, the interleukin-1 receptor antagonist, the fusion proteins GI-3 and GI-7 (two representative fusion proteins of the GIP receptor binding polypeptide—linking group—the interleukin-1 receptor antagonistic protein) for 12 weeks, and then examined for the change of blood glucose in a glucose tolerance test.

In the test shown in FIG. 10, better blood glucose control was demonstrated in the IL-1Ra group as compared with that in the control group with physiological saline. Furthermore, the glucose tolerance in the mice of GI-3 and GI-7 groups was markedly enhanced, with a low peak of blood glucose. During 12 weeks of treatment, dosages of the GI-3 and GI-7 were only ⅒ of the dosage of IL-1Ra, demonstrating that the fusion protein of the GIP receptor binding polypeptide and the interleukin-1 receptor antagonistic protein has an in vivo biological activity and a therapeutic effect significantly superior to those of the IL-1Ra.

While the fusion proteins in the above-mentioned tests were not certainly superior to the standard proteins (IL-1Ra, GLP (7-37), the human insulin, and GIP (1-42)) in the corresponding receptor-binding assays (Tables 1, 2, and 3), the fusion proteins exhibited in vivo more excellent biological activities and therapeutic effects through the synergism of the two constituent proteins/polypeptides, which verifies the correctness of methods of designing and preparing the fusion proteins in the present invention. The fusion proteins in the present invention are a promising class of novel compounds for prophylaxis and treatment of diabetes.

SEQUENCE LISTING (521 sequences)

SEQ ID NO: 1 - protein, 191 aa, Artificial Sequence
  Description of Artificial Sequence: Synthetic fusion protein G-1
HGEGTFTSDLSKQMEEEAVRLFIEWLKNGGPSSGAPPPSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 2 - protein, 196 aa, Artificial Sequence
  Description of Artificial Sequence: Synthetic fusion protein G-2
HGEGTFTSDLSKQMEEEAVRLFIEWLKNGGPSSGAPPPSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 3 - protein, 201 aa, Artificial Sequence
  Description of Artificial Sequence: Synthetic fusion protein G-3
HGEGTFTSDLSKQMEEEAVRLFIEWLKNGGPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 4 - protein, 206 aa, Artificial Sequence
  Description of Artificial Sequence: Synthetic fusion protein G-4
HGEGTFTSDLSKQMEEEAVRLFIEWLKNGGPSSGAPPPSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 5 - protein, 182 aa, Artificial Sequence
  Description of Artificial Sequence: Synthetic fusion protein G-5
HGEGTFTSDLSKQMEEEAVRLFIEWLKNGGRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6 - protein, 185 aa, Artificial Sequence
  Description of Artificial Sequence: Synthetic fusion protein G-6
HGEGTFTSDLSKQMEEEAVRLFIEWLKNGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 7 - protein, 190 aa, Artificial Sequence
  Description of Artificial Sequence: Synthetic fusion protein G-7
HGEGTFTSDLSKQMEEEAVRLFIEWLKNGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 8 - protein, 195 aa, Artificial Sequence
  Description of Artificial Sequence: Synthetic fusion protein G-8
HGEGTFTSDLSKQMEEEAVRLFIEWLKNGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 9 - protein, 196 aa, Artificial Sequence; identical to SEQ ID NO: 2
  Description of Artificial Sequence: Synthetic fusion protein G-9
  MOD_RES (160)..(160): S-maleimide-(CH2)4-NH-(Nalpha-(HOOC(CH2)14CO)-gamma-Glu), S is the sulphur atom on the side chain of a cysteine residue

SEQ ID NO: 10 - protein, 196 aa, Artificial Sequence
  Description of Artificial Sequence: Synthetic fusion protein G-10
  MOD_RES (128)..(128): S-CH2-CONH-PEG20K,S is the sulphur atom on the side chain of a cysteine residue
HGEGTFTSDLSKQMEEEAVRLFIEWLKNGGPSSGAPPPSGGGGSRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 11 - protein, 191 aa, Artificial Sequence
  Description of Artificial Sequence: Synthetic fusion protein G-11
  MOD_RES (155)..(155): S-CH2-CONH-PEG20K,S is the sulphur atom on the side chain of a cysteine residue
HGEGTFTSDLSKQMEEEAVRLFIEWLKNGGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 12 - protein, 201 aa, Artificial Sequence
  Description of Artificial Sequence: Synthetic fusion protein G-12
  MOD_RES (133)..(133): S-maleimide-(CH2)4-NH-(Nalpha-(HOOC(CH2)14CO)-gamma-Glu), S is the sulphur atom on the side chain of a cysteine residue
HGEGTFTSDLSKQMEEEAVRLFIEWLKNGGPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 13 - protein, 185 aa, Artificial Sequence; identical to SEQ ID NO: 6
  Description of Artificial Sequence: Synthetic fusion protein G-13
  MOD_RES (149)..(149): S-maleimide-PEG20K, S is the sulphur atom on the side chain of a cysteine residue

SEQ ID NO: 14 - protein, 185 aa, Artificial Sequence
  Description of Artificial Sequence: Synthetic fusion protein G-14
  MOD_RES (117)..(117): S-maleimide-(CH2)4-NH-(Nalpha-(HOOC(CH2)14CO)-gamma-Glu), S is the sulphur atom on the side chain of a cysteine residue
HGEGTFTSDLSKQMEEEAVRLFIEWLKNGGGGSRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 15 - protein, 201 aa, Artificial Sequence
  Description of Artificial Sequence: Synthetic fusion protein G-15
  MOD_RES (27)..(27): S-maleimide-(CH2)4-NH-(Nalpha-(HOOC(CH2)14CO) -gamma-Glu), S is the sulphur atom on the side chain of a cysteine residue
HGEGTFTSDLSKQMEEEAVRLFIEWLCNGGPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 16 - protein, 201 aa, Artificial Sequence
  Description of Artificial Sequence: Synthetic fusion protein G-16
  MOD_RES (39)..(39): S-CH2-CONH- PEG20K,S is the sulphur atom on the side chain of a cysteine residue
HGEGTFTSDLSKQMEEEAVRLFIEWLKNGGPSSGAPPPCGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 17 - protein, 201 aa, Artificial Sequence
  Description of Artificial Sequence: Synthetic fusion protein G-17
  MOD_RES (20)..(20): S-maleimide-(CH2)4-NH-(Nalpha-(HOOC(CH2)14CO)-gamma-Glu), S is the sulphur atom on the side chain of a cysteine residue
HGEGTFTSDLSKQMEEEAVCLFIEWLKNGGPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 18 - protein, 183 aa, Artificial Sequence
  Description of Artificial Sequence: Synthetic fusion protein G-18
HGEGTFTSDVSSYLEEQAAKEFIAWLVKGRGRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 19 - protein, 187 aa, Artificial Sequence
  Description of Artificial Sequence: Synthetic fusion protein G-19
HGEGTFTSDVSSYLEEQAAKEFIAWLVKGRGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 20 - protein, 192 aa, Artificial Sequence
  Description of Artificial Sequence: Synthetic fusion protein G-20
HGEGTFTSDVSSYLEEQAAKEFIAWLVKGRGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 21 - protein, 197 aa, Artificial Sequence
  Description of Artificial Sequence: Synthetic fusion protein G-21
HGEGTFTSDVSSYLEEQAAKEFIAWLVKGRGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 22 - protein, 201 aa, Artificial Sequence
  Description of Artificial Sequence: Synthetic fusion protein G-22
HGEGTFTSDVSSYLEEQAAKEFIAWLVKGRPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 23 - protein, 183 aa, Artificial Sequence; identical to SEQ ID NO: 18
  Description of Artificial Sequence: Synthetic fusion protein G-23
  MOD_RES (147)..(147): S-CH2-CONH-PEG20K,S is the sulphur atom on the side chain of a cysteine residue

SEQ ID NO: 24 - protein, 187 aa, Artificial Sequence; identical to SEQ ID NO: 19
  Description of Artificial Sequence: Synthetic fusion protein G-24
  MOD_RES (151)..(151): S-CH2-CONH-PEG20K,S is the sulphur atom on the side chain of a cysteine residue

SEQ ID NO: 25 - protein, 187 aa, Artificial Sequence
  Description of Artificial Sequence: Synthetic fusion protein G-25
  MOD_RES (119)..(119): S-maleimide-(CH2)4-NH-(Nalpha-(HOOC(CH2)14CO)-gamma-Glu), S is the sulphur atom on the side chain of a cysteine residue
HGEGTFTSDVSSYLEEQAAKEFIAWLVKGRGGGGSRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 26 - protein, 192 aa, Artificial Sequence; identical to SEQ ID NO: 20
  Description of Artificial Sequence: Synthetic fusion protein G-26
  MOD_RES (156)..(156): S-CH2-CONH-PEG20K,S is the sulphur atom on the side chain of a cysteine residue

SEQ ID NO: 27 - protein, 192 aa, Artificial Sequence
  Description of Artificial Sequence: Synthetic fusion protein G-27
  MOD_RES (124)..(124): S-maleimide-(CH2)4-NH-(Nalpha-(HOOC(CH2)14CO)-gamma-Glu), S is the sulphur atom on the side chain of a cysteine residue
HGEGTFTSDVSSYLEEQAAKEFIAWLVKGRGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 28 - protein, 197 aa, Artificial Sequence; identical to SEQ ID NO: 21
  Description of Artificial Sequence: Synthetic fusion protein G-28
  MOD_RES (161)..(161): S-CH2-CONH-PEG20K,S is the sulphur atom on the side chain of a cysteine residue

SEQ ID NO: 29 - protein, 201 aa, Artificial Sequence; identical to SEQ ID NO: 22
  Description of Artificial Sequence: Synthetic fusion protein G-29
  MOD_RES (165)..(165): S-maleimide-(CH2)4-NH-(Nalpha-(HOOC(CH2)14CO)-gamma-Glu), S is the sulphur atom on the side chain of a cysteine residue

SEQ ID NO: 30 - protein, 201 aa, Artificial Sequence; identical to SEQ ID NO: 16
  Description of Artificial Sequence: Synthetic fusion protein G-30
  MOD_RES (39)..(39): S-maleimide-(CH2)15-COOH,S is the sulphur atom on the side chain of a cysteine residue

SEQ ID NO: 31 - protein, 201 aa, Artificial Sequence; identical to SEQ ID NO: 16
  Description of Artificial Sequence: Synthetic fusion protein G-31
  MOD_RES (39)..(39): S-maleimide-(CH2)17-COOH, S is the sulphur atom on the side chain of a cysteine residue

SEQ ID NO: 32 - protein, 201 aa, Artificial Sequence; identical to SEQ ID NO: 16
  Description of Artificial Sequence: Synthetic fusion protein G-32
  MOD_RES (39)..(39): S-CH2-CONH-(CH2CH2O)2-(CH2)2-NH-(Nalpha-(HOOC(CH2)14CO)- gamma-Glu),S is the sulphur atom on the side chain of a cysteine residue

SEQ ID NO: 33 - protein, 201 aa, Artificial Sequence; identical to SEQ ID NO: 15
  Description of Artificial Sequence: Synthetic fusion protein G-33
  MOD_RES (27)..(27): S-CH2-CONH-(CH2CH2O)2-(CH2)2-NH-(Nalpha- (HOOC(CH2)14CO)-gamma-Glu),S is the sulphur atom on the side chain of a cysteine residue

SEQ ID NO: 34 - protein, 201 aa, Artificial Sequence; identical to SEQ ID NO: 17
  Description of Artificial Sequence: Synthetic fusion protein G-34
  MOD_RES (20)..(20): S-CH2-CONH-(CH2CH2O)2-(CH2)2-NH-(Nalpha-(HOOC(CH2)14 CO)-gamma-Glu),S is the sulphur atom on the side chain of a cysteine residue

SEQ ID NO: 35 - protein, 201 aa, Artificial Sequence
  Description of Artificial Sequence: Synthetic fusion protein G-35
  MOD_RES (32)..(32): S-CH2-CONH-(CH2CH2O)2-(CH2)2-NH-(Nalpha-(HOOC(CH2)14CO)- gamma-Glu),S is the sulphur atom on the side chain of a cysteine residue
HGEGTFTSDLSKQMEEEAVRLFIEWLKNGGPCSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 36 - protein, 201 aa, Artificial Sequence; identical to SEQ ID NO: 12
  Description of Artificial Sequence: Synthetic fusion protein G-36
  MOD_RES (133)..(133): S-maleimide-(CH2)15-COOH,S is the sulphur atom on the side chain of a cysteine residue

SEQ ID NO: 37 - protein, 201 aa, Artificial Sequence; identical to SEQ ID NO: 12
  Description of Artificial Sequence: Synthetic fusion protein G-37
  MOD_RES (133)..(133): S-CH2-CONH-(CH2CH2O)2-(CH2)2-NH-(Nalpha-(HOOC(CH2)14CO)- gamma-Glu),S is the sulphur atom on the side chain of a cysteine residue

SEQ ID NO: 38 - protein, 201 aa, Artificial Sequence; identical to SEQ ID NO: 3
  Description of Artificial Sequence: Synthetic fusion protein G-38
  MOD_RES (165)..(165): S-maleimide-(CH2)17-COOH,S is the sulphur atom on the side chain of a cysteine residue

SEQ ID NO: 39 - protein, 201 aa, Artificial Sequence; identical to SEQ ID NO: 3
  Description of Artificial Sequence: Synthetic fusion protein G-39
  MOD_RES (165)..(165): S-CH2-CONH-(CH2CH2O)4-(CH2)2-NH-(Nalpha-(HOOC(CH2)16CO) -gamma-Glu),S is the sulphur atom on the side chain of a cysteine residue

SEQ ID NO: 40 - protein, 193 aa, Artificial Sequence
  Description of Artificial Sequence: Synthetic fusion protein G-40
  MOD_RES (31)..(31): S-maleimide-(CH2)15-COOH,S is the sulphur atom on the side chain of a cysteine residue
HGEGTFTSDVSSYLEEQAAKEFIAWLVKGRCGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 41 - protein, 193 aa, Artificial Sequence; identical to SEQ ID NO: 40
  Description of Artificial Sequence: Synthetic fusion protein G-41
  MOD_RES (31)..(31): S-CH2-CONH-(CH2CH2O)2-(CH2)2-NH-(Nalpha- (HOOC(CH2)14CO)-gamma-Glu),S is the sulphur atom on the side chain of a cysteine residue

SEQ ID NO: 42 - protein, 192 aa, Artificial Sequence; identical to SEQ ID NO: 27
  Description of Artificial Sequence: Synthetic fusion protein G-42
  MOD_RES (124)..(124): S-maleimide-(CH2)17-COOH,S is the sulphur atom on the side chain of a cysteine residue

SEQ ID NO: 43 - protein, 192 aa, Artificial Sequence
  Description of Artificial Sequence: Synthetic fusion protein G-43
  MOD_RES (20)..(20): S-CH2-CONH-(CH2CH2O)2-(CH2)2-NH-(Nalpha-(HOOC(CH2)14CO) -gamma-Glu),S is the sulphur atom on the side chain of a cysteine residue
HGEGTFTSDVSSYLEEQAACEFIAWLVKGRGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 44 - protein, 192 aa, Artificial Sequence
  Description of Artificial Sequence: Synthetic fusion protein G-44
  MOD_RES (20)..(20): S-CH2-CONH-(CH2CH2O)2-(CH2)2-NH-(Nalpha-(HOOC(CH2)14CO) -gamma-Glu),S is the sulphur atom on the side chain of a cysteine residue
HAEGTFTSDVSSYLEGQAACEFIAWLVKGRGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 45 - protein, 192 aa, Artificial Sequence
  Description of Artificial Sequence: Synthetic fusion protein G-45
  MOD_RES (10)..(10): S-CH2-CONH-(CH2CH2O)2-(CH2)2-NH-(Nalpha-(HOOC(CH2)14CO- gamma-Glu-N-gamma-Glu),S is the sulphur atom on the side chain of a cysteine residue
HGEGTFTSDCSSYLEEQAAKEFIAWLVKGRGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 46 - protein, 192 aa, Artificial Sequence
  Description of Artificial Sequence: Synthetic fusion protein G-46
  MOD_RES (10)..(10): S-CH2-CONH-(CH2CH2O)2-(CH2)2-NH-(Nalpha-(HOOC(CH2)14CO) -gamma-Glu),S is the sulphur atom on the side chain of a cysteine residue
HAEGTFTSDCSSYLEGQAAKEFIAWLVKGRGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 47 - protein, 192 aa, Artificial Sequence
  Description of Artificial Sequence: Synthetic fusion protein G-47
  MOD_RES (28)..(28): S-CH2-CONH-(CH2CH2O)2-(CH2)2-NH-(Nalpha-(HOOC(CH2)14CO)- gamma-Glu),S is the sulphur atom on the side chain of a cysteine residue
HGEGTFTSDVSSYLEEQAAKEFIAWLVCGRGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 48 - protein, 192 aa, Artificial Sequence; identical to SEQ ID NO: 27
  Description of Artificial Sequence: Synthetic fusion protein G-48
  MOD_RES (124)..(124): S-CH2-CONH-(CH2CH2O)4-(CH2)2-NH-(Nalpha-(HOOC(CH2)16CO)- gamma-Glu),S is the sulphur atom on the side chain of a cysteine residue

SEQ ID NO: 49 - protein, 192 aa, Artificial Sequence; identical to SEQ ID NO: 20
  Description of Artificial Sequence: Synthetic fusion protein G-49
  MOD_RES (156)..(156): S-maleimide-(CH2)15-COOH,S is the sulphur atom on the side chain of a cysteine residue

SEQ ID NO: 50 - protein, 192 aa, Artificial Sequence; identical to SEQ ID NO: 20
  Description of Artificial Sequence: Synthetic fusion protein G-50
  MOD_RES (156)..(156): S-CH2-CONH-(CH2CH2O)2-(CH2)2-NH-(Nalpha-(HOOC(CH2)14CO)- gamma-Glu),S is the sulphur atom on the side chain of a cysteine residue

SEQ ID NO: 51 - protein, 152 aa, Artificial Sequence
  Description of Artificial Sequence: Synthetic fusion protein G-51
  MOD_RES (84)..(84): S-maleimide-PEG11-maleimide-S-GLP-1 receptor binding polypeptide,S is the sulphur atom on the side chain of a cysteine residue;wherein the GLP-1 receptor binding polypeptide has the following sequence of SEQ ID NO:185
  MOD_RES (84)..(84): and is linked to the interleukin-1 receptor antagonistic protein by reacting the mercapto group on the side chain of a terminal cysteine residue with the maleimide
RPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 52 - protein, 152 aa, Artificial Sequence
  Description of Artificial Sequence: Synthetic fusion protein G-52
  MOD_RES (116)..(116): S-maleimide-PEG11-maleimide-S-GLP-1 receptor binding polypeptide,S is the sulphur atom on the side chain of a cysteine residue,wherein the GLP-1 receptor binding polypeptide has the sequence of SEQ ID NO: 185 and is
  MOD_RES (116)..(116): linked to the interleukin-1 receptor antagonistic protein by reacting the mercapto group on the side chain of a terminal cysteine residue with the maleimide;
RPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 53 - protein, 152 aa, Artificial Sequence; identical to SEQ ID NO: 51
  Description of Artificial Sequence: Synthetic fusion protein G-53
  MOD_RES (84)..(84): S-maleimide-PEG11-maleimide-S-GLP-1 receptor binding polypeptide,S is the sulphur atom on the side chain of a cysteine residue,wherein the GLP-1 receptor binding polypeptide has the following sequence of
  MOD_RES (84)..(84): SEQ ID NO:186 and is linked to the interleukin-1 receptor antagonistic protein by reacting the mercapto group on the side chain of a terminal cysteine residue with the maleimide;

SEQ ID NO: 54 - protein, 152 aa, Artificial Sequence; identical to SEQ ID NO: 52
  Description of Artificial Sequence: Synthetic fusion protein G-54
  MOD_RES (116)..(116): S-maleimide-PEG11-maleimide-S-GLP-1 receptor binding polypeptide,S is the sulphur atom on the side chain of a cysteine residue,wherein the the GLP-1 receptor
  MOD_RES (116)..(116): binding polypeptide has the sequence of SEQ ID NO: 186 and is linked to the interleukin-1 receptor antagonistic protein by reacting the mercapto group on the side chain of a terminal cysteine residue with the maleimide;

SEQ ID NO: 55 - protein, 152 aa, Artificial Sequence; identical to SEQ ID NO: 51
  Description of Artificial Sequence: Synthetic fusion protein G-55
  MOD_RES (84)..(84): S-maleimide-PEG11-maleimide-S-GLP-1 receptor binding polypeptide,S is the sulphur atom on the side chain of a cysteine residue, wherein the GLP-1 receptor binding polypeptide has the following sequence of
  MOD_RES (84)..(84): SEQ ID NO:187 and is linked to the interleukin-1 receptor antagonistic protein by reacting the mercapto group on the side chain of a cysteine residue with the maleimide

SEQ ID NO: 56 - protein, 152 aa, Artificial Sequence; identical to SEQ ID NO: 52
  Description of Artificial Sequence: Synthetic fusion protein G-56
  MOD_RES (116)..(116): S-maleimide-PEG11-maleimide-S-GLP-1 receptor binding polypeptide,S is the sulphur atom on the side chain of a cysteine residue,wherein the GLP-1 receptor binding polypeptide has the sequence of SEQ ID NO:187 and is
  MOD_RES (116)..(116): linked to the interleukin-1 receptor antagonistic protein by reacting the mercapto group on the side chain of a cysteine residue with the maleimide

SEQ ID NO: 57 - protein, 152 aa, Artificial Sequence; identical to SEQ ID NO: 51
  Description of Artificial Sequence: Synthetic fusion protein G-57
  MOD_RES (84)..(84): S-maleimide-PEG11-maleimide-S-GLP-1 receptor binding polypeptide,S is the sulphur atom on the side chain of a cysteine residue,wherein the GLP-1 receptor binding polypeptide has the following sequence of SEQ ID
  MOD_RES (84)..(84): NO:188 and is linked to the interleukin-1 receptor antagonistic protein by reacting the mercapto group on the side chain of a cysteine residue with the maleimide

SEQ ID NO: 58 - protein, 152 aa, Artificial Sequence; identical to SEQ ID NO: 52
  Description of Artificial Sequence: Synthetic fusion protein G-58
  MOD_RES (116)..(116): S-maleimide-PEG11-maleimide-S-GLP-1 receptor binding polypeptide, S is the sulphur atom on the side chain of a cysteine residue, wherein the the GLP-1 receptor binding polypeptide has the sequence of SEQ ID NO: 188
  MOD_RES (116)..(116): and is linked to the interleukin-1 receptor antagonistic protein by reacting the mercapto group on the side chain of a cysteine residue with the maleimide

SEQ ID NO: 59 - protein, 152 aa, Artificial Sequence; identical to SEQ ID NO: 51
  Description of Artificial Sequence: Synthetic fusion protein G-59
  MOD_RES (84)..(84): S-maleimide-PEG20K-maleimide-S-GLP-1 receptor binding polypeptide,S is the sulphur atom on the side chain of a cysteine residue,wherein the GLP-1 receptor binding polypeptide has the sequence of SEQ ID NO: 185 and is
  MOD_RES (84)..(84): linked to the interleukin-1 receptor antagonistic protein by reacting the mercapto group on the side chain of a terminal cysteine residue with the maleimide

SEQ ID NO: 60 - protein, 152 aa, Artificial Sequence; identical to SEQ ID NO: 52
  Description of Artificial Sequence: Synthetic fusion protein G-60
  MOD_RES (116)..(116): S-maleimide-PEG20K-maleimide-S-GLP-1 receptor binding polypeptide,S is the sulphur atom on the side chain of a cysteine residue,wherein the GLP-1 receptor binding polypeptide has the sequence of SEQ ID NO: 185 and is
  MOD_RES (116)..(116): linked to the interleukin-1 receptor antagonistic protein by reacting the mercapto group on the side chain of a terminal cysteine residue with the maleimide

SEQ ID NO: 61 - protein, 152 aa, Artificial Sequence; identical to SEQ ID NO: 51
  Description of Artificial Sequence: Synthetic fusion protein G-61
  MOD_RES (84)..(84): S-maleimide-PEG20K-maleimide-S-GLP-1 receptor binding polypeptide,S is the sulphur atom on the side chain of a cysteine residue,wherein the GLP-1 receptor binding polypeptide has the following sequence of SEQ ID NO:189
  MOD_RES (84)..(84): and is linked to the interleukin-1 receptor antagonistic protein by reacting the mercapto group on the side chain of a terminal cysteine residue with the maleimide

SEQ ID NO: 62 - protein, 152 aa, Artificial Sequence; identical to SEQ ID NO: 52
  Description of Artificial Sequence: Synthetic fusion protein G-62
  MOD_RES (116)..(116): S-maleimide-PEG20K-maleimide-S-GLP-1 receptor binding polypeptide,S is the sulphur atom on the side chain of a cysteine residue,wherein the GLP-1 receptor binding polypeptide has the sequence of SEQ ID NO: 186 and is
  MOD_RES (116)..(116): linked to the interleukin-1 receptor antagonistic protein by reacting the mercapto group on the side chain of a terminal cysteine residue with the maleimide

SEQ ID NO: 63 - protein, 152 aa, Artificial Sequence; identical to SEQ ID NO: 51
  Description of Artificial Sequence: Synthetic fusion protein G-63
  MOD_RES (84)..(84): S-maleimide-PEG20K-maleimide-S-GLP-1 receptor binding polypeptide,S is the sulphur atom on the side chain of a cysteine residue, wherein the GLP-1 receptor binding polypeptide has the sequence of SEQ ID NO: 187 and is
  MOD_RES (84)..(84): linked to the interleukin-1 receptor antagonistic protein by reacting the mercapto group on the side chain of a cysteine residue with the maleimide

SEQ ID NO: 64 - protein, 152 aa, Artificial Sequence; identical to SEQ ID NO: 52
  Description of Artificial Sequence: Synthetic fusion protein G-64
  MOD_RES (116)..(116): S-maleimide-PEG20K-maleimide-S-GLP-1 receptor binding polypeptide,S is the sulphur atom on the side chain of a cysteine residue,wherein the GLP-1 receptor binding polypeptide has the following sequence of SEQ ID NO:190
  MOD_RES (116)..(116): and is linked to the interleukin-1 receptor antagonistic protein by reacting the mercapto group on the side chain of a cysteine residue with the maleimide

SEQ ID NO: 65 - protein, 152 aa, Artificial Sequence; identical to SEQ ID NO: 51
  Description of Artificial Sequence: Synthetic fusion protein G-65
  MOD_RES (84)..(84): S-maleimide-PEG20K-maleimide-S-GLP-1 receptor binding polypeptide,S is the sulphur atom on the side chain of a cysteine residue, wherein the GLP-1 receptor binding polypeptide has the sequence of SEQ ID NO: 188 and is
  MOD_RES (84)..(84): linked to the interleukin-1 receptor antagonistic protein by reacting the mercapto group on the side chain of a cysteine residue with the maleimide

SEQ ID NO: 66 - protein, 152 aa, Artificial Sequence; identical to SEQ ID NO: 52
  Description of Artificial Sequence: Synthetic fusion protein G-66
  MOD_RES (116)..(116): S-maleimide-PEG20K-maleimide-S-GLP-1 receptor binding polypeptide,S is the sulphur atom on the side chain of a cysteine residue, wherein the GLP-1 receptor binding polypeptide has the sequence of SEQ ID NO: 188 and is
  MOD_RES (116)..(116): linked to the interleukin-1 receptor antagonistic protein by reacting the mercapto group on the side chain of a cysteine residue with the maleimide

SEQ ID NO: 67 - protein, 153 aa, Artificial Sequence
  Description of Artificial Sequence: Synthetic fusion protein G-67
  MOD_RES (1)..(1): GLP-1 receptor binding polypeptide-S-maleimide-PEG20K- maleimide-S,S is the sulphur atom on the side chain of a cysteine residu,wherein the GLP-1 receptor binding polypeptide has the sequence of SEQ ID NO: 185 and is
  MOD_RES (1)..(1): linked to the interleukin-1 receptor antagonistic protein by reacting the mercapto group on the side chain of a terminal cysteine residue with the maleimide
CRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 68 - protein, 152 aa, Artificial Sequence; identical to SEQ ID NO: 52
  Description of Artificial Sequence: Synthetic fusion protein G-68
  MOD_RES (1)..(1): PEG20K
  MOD_RES (116)..(116): S-maleimide-PEG11-maleimide-S-GLP-1 receptor binding polypeptide,S is the sulphur atom on the side chain of a cysteine residue,wherein the GLP-1 receptor binding polypeptide has the sequence of SEQ ID NO: 185 and is
  MOD_RES (116)..(116): linked to the interleukin-1 receptor antagonistic protein by reacting the mercapto group on the side chain of a terminal cysteine residue with the maleimide

SEQ ID NO: 69 - protein, 152 aa, Artificial Sequence; identical to SEQ ID NO: 51
  Description of Artificial Sequence: Synthetic fusion protein G-69
  MOD_RES (1)..(1): PEG20K
  MOD_RES (84)..(84): S-maleimide-PEG11-maleimide-S-GLP-1 receptor binding polypeptide,S is the sulphur atom on the side chain of a cysteine residue,wherein the GLP-1 receptor binding polypeptide has the sequence of SEQ ID NO: 186 and is
  MOD_RES (84)..(84): linked to the interleukin-1 receptor antagonistic protein by reacting the mercapto group on the side chain of a terminal cysteine residue with the maleimide

SEQ ID NO: 70 - protein, 153 aa, Artificial Sequence; identical to SEQ ID NO: 67
  Description of Artificial Sequence: Synthetic fusion protein G-70
  MOD_RES (1)..(1): GLP-1 receptor binding polypeptide-S-maleimide-PEG20K- maleimide-S,S is the sulphur atom on the side chain of a cysteine residue, wherein the GLP-1 receptor binding polypeptide has the sequence of SEQ ID NO: 189 and is
  MOD_RES (1)..(1): linked to the interleukin-1 receptor antagonistic protein by reacting the mercapto group on the side chain of a terminal cysteine residue with the maleimide

SEQ ID NO: 71 - protein, 152 aa, Artificial Sequence; identical to SEQ ID NO: 51
  Description of Artificial Sequence: Synthetic fusion protein G-71
  MOD_RES (84)..(84): S-maleimide-PEG11-maleimide-S-GLP-1 receptor binding polypeptide,S is the sulphur atom on the side chain of a cysteine residue, wherein the GLP-1 receptor binding polypeptide has the following sequence of SEQ ID NO:191
  MOD_RES (84)..(84): and is linked to the interleukin-1 receptor antagonistic protein by reacting the mercapto group on the side chain of a terminal cysteine residue with the maleimide

SEQ ID NO: 72 - protein, 152 aa, Artificial Sequence; identical to SEQ ID NO: 52
  Description of Artificial Sequence: Synthetic fusion protein G-72
  MOD_RES (116)..(116): S-maleimide-PEG11-maleimide-S-GLP-1 receptor binding polypeptide,S is the sulphur atom on the side chain of a cysteine residue, wherein the GLP-1 receptor binding polypeptide has the sequence of SEQ ID NO: 191 and is
  MOD_RES (116)..(116): linked to the interleukin-1 receptor antagonistic protein by reacting the mercapto group on the side chain of a terminal cysteine residue with the maleimide

SEQ ID NO: 73 - protein, 152 aa, Artificial Sequence; identical to SEQ ID NO: 51
  Description of Artificial Sequence: Synthetic fusion protein G-73
  MOD_RES (84)..(84): S-maleimide-PEG11-maleimide-S-GLP-1 receptor binding polypeptide,S is the sulphur atom on the side chain of a cysteine residue, wherein the GLP-1 receptor binding polypeptide has the sequence of SEQ ID NO:189 and is
  MOD_RES (84)..(84): linked to the interleukin-1 receptor antagonistic protein by reacting the mercapto group on the side chain of a terminal cysteine residue with the maleimide

SEQ ID NO: 74 - protein, 152 aa, Artificial Sequence; identical to SEQ ID NO: 52
  Description of Artificial Sequence: Synthetic fusion protein G-74
  MOD_RES (116)..(116): S-maleimide-PEG11-maleimide-S-GLP-1 receptor binding polypeptide,S is the sulphur atom on the side chain of a cysteine residue,wherein the GLP-1 receptor binding polypeptide has the sequence of SEQ ID NO:189 and is
  MOD_RES (116)..(116): linked to the interleukin-1 receptor antagonistic protein by reacting the mercapto group on the side chain of a terminal cysteine residue with the maleimide

SEQ ID NO: 75 - protein, 152 aa, Artificial Sequence; identical to SEQ ID NO: 51
  Description of Artificial Sequence: Synthetic fusion protein G-75
  MOD_RES (84)..(84): S-maleimide-PEG11-maleimide-S-GLP-1 receptor binding polypeptide,S is the sulphur atom on the side chain of a cysteine residue, wherein the GLP-1 receptor binding polypeptide has the sequence of SEQ ID NO: 190 and is
  MOD_RES (84)..(84): linked to the interleukin-1 receptor antagonistic protein by reacting the mercapto group on the side chain of a cysteine residue with the maleimide

SEQ ID NO: 76 - protein, 152 aa, Artificial Sequence; identical to SEQ ID NO: 52
  Description of Artificial Sequence: Synthetic fusion protein G-76
  MOD_RES (116)..(116): S-maleimide-PEG11-maleimide-S-GLP-1 receptor binding polypeptide,S is the sulphur atom on the side chain of a cysteine residue, wherein the GLP-1 receptor binding polypeptide has the sequence of SEQ ID NO: 190 and is
  MOD_RES (116)..(116): linked to the interleukin-1 receptor antagonistic protein by reacting the mercapto group on the side chain of a cysteine residue with the maleimide

SEQ ID NO: 77 - protein, 152 aa, Artificial Sequence; identical to SEQ ID NO: 51
  Description of Artificial Sequence: Synthetic fusion protein G-77
  MOD_RES (84)..(84): S-maleimide-PEG11-maleimide-S-GLP-1 receptor binding polypeptide,S is the sulphur atom on the side chain of a cysteine residue,wherein the GLP-1 receptor binding polypeptide has the following sequence of SEQ ID NO:192
  MOD_RES (84)..(84): and is linked to the interleukin-1 receptor antagonistic protein by reacting the mercapto group on the side chain of a cysteine residue with the maleimide

SEQ ID NO: 78 - protein, 152 aa, Artificial Sequence; identical to SEQ ID NO: 52
  Description of Artificial Sequence: Synthetic fusion protein G-78
  MOD_RES (116)..(116): S-maleimide-PEG11-maleimide-S-GLP-1 receptor binding polypeptide,S is the sulphur atom on the side chain of a cysteine residue,, wherein the GLP-1 receptor binding polypeptide has the sequence of SEQ ID NO: 192 and is
  MOD_RES (116)..(116): linked to the interleukin-1 receptor antagonistic protein by reacting the mercapto group on the side chain of a cysteine residue with the maleimide

SEQ ID NO: 79 - protein, 152 aa, Artificial Sequence; identical to SEQ ID NO: 51
  Description of Artificial Sequence: Synthetic fusion protein G-79
  MOD_RES (84)..(84): S-maleimide-PEG11-maleimide-S-GLP-1 receptor binding polypeptide,S is the sulphur atom on the side chain of a cysteine residue, wherein the GLP-1 receptor binding polypeptide has the following sequence of SEQ ID NO:193
  MOD_RES (84)..(84): and is linked to the interleukin-1 receptor antagonistic protein by reacting the mercapto group on the side chain of a terminal cysteine residue with the maleimide;

SEQ ID NO: 80 - protein, 152 aa, Artificial Sequence; identical to SEQ ID NO: 52
  Description of Artificial Sequence: Synthetic fusion protein G-80
  MOD_RES (116)..(116): S-maleimide-PEG11-maleimide-S-GLP-1 receptor binding polypeptide, S is the sulphur atom on the side chain of a cysteine residue,wherein the GLP-1 receptor binding polypeptide has the sequence of SEQ ID NO: 193 and is
  MOD_RES (116)..(116): linked to the interleukin-1 receptor antagonistic protein by reacting the mercapto group on the side chain of a terminal cysteine residue with the maleimide

SEQ ID NO: 81 - protein, 796 aa, Artificial Sequence
  Description of Artificial Sequence: Synthetic fusion protein G-81
HGEGTFTSDLSKQMEEEAVRLFIEWLKNGGPSSGAPPPSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 82 - protein, 796 aa, Artificial Sequence [sequence omitted]

SEQ ID NO: 83 - protein, 796 aa, Artificial Sequence
  Description of Artificial Sequence: Synthetic fusion protein G-83
HGEGTFTSDLSKQMEEEAVRLFIEWLKNGGPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 84 - protein, 796 aa, Artificial Sequence
  Description of Artificial Sequence: Synthetic fusion protein G-84
HGEGTFTSDVSSYLEEQAAKEFIAWLVKGRPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 85 - protein, 215 aa, Artificial Sequence
  Description of Artificial Sequence: Synthetic fusion protein IN-1
FVNQHLCGSHLVEALYLVCGERGFFYTPKTGSGSSSAAAPQTGIVEQCCTSICSLYQLENYCNRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 86 - protein, 215 aa, Artificial Sequence
  Description of Artificial Sequence: Synthetic fusion protein IN-2
FVNQHLCGSHLVEALYLVCGERGFFYTPKTGSGSSSAAAPQTGIVEQCCTSICSLYQLENYCNRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 87 - protein, 215 aa, Artificial Sequence
  Description of Artificial Sequence: Synthetic fusion protein IN-3
FVNQHLCGSHLVEALYLVCGERGFFYTPKTGSGSSSAAAPQTGIVEQCCTSICSLYQLENYCNRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE

SEQ ID NO: 88 - protein, 220 aa, Artificial Sequence
  Description of Artificial Sequence: Synthetic fusion protein IN-4
FVNQHLCGSHLVEALYLVCGERGFFYTPKTGSGSSSAAAPQTGIVEQCCTSICSLYQLENYCNGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 89 - protein, 220 aa, Artificial Sequence
  Description of Artificial Sequence: Synthetic fusion protein IN-5
FVNQHLCGSHLVEALYLVCGERGFFYTPKTGSGSSSAAAPQTGIVEQCCTSICSLYQLENYCNGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 90 - protein, 220 aa, Artificial Sequence
  Description of Artificial Sequence: Synthetic fusion protein IN-6
FVNQHLCGSHLVEALYLVCGERGFFYTPKTGSGSSSAAAPQTGIVEQCCTSICSLYQLENYCNGGGGSRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE

SEQ ID NO: 91 - protein, 225 aa, Artificial Sequence
  Description of Artificial Sequence: Synthetic fusion protein IN-7
FVNQHLCGSHLVEALYLVCGERGFFYTPKTGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 92 - protein, 225 aa, Artificial Sequence
  Description of Artificial Sequence: Synthetic fusion protein IN-8
FVNQHLCGSHLVEALYLVCGERGFFYTPKTGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 93 - protein, 225 aa, Artificial Sequence
  Description of Artificial Sequence: Synthetic fusion protein IN-9
FVNQHLCGSHLVEALYLVCGERGFFYTPKTGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE

SEQ ID NO: 94 - protein, 230 aa, Artificial Sequence
  Description of Artificial Sequence: Synthetic fusion protein IN-10
FVNQHLCGSHLVEALYLVCGERGFFYTPKTGSGSSSAAAPQTGIVEQCCTSICSLYQLENYCNGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 95 - protein, 230 aa, Artificial Sequence
  Description of Artificial Sequence: Synthetic fusion protein IN-11
FVNQHLCGSHLVEALYLVCGERGFFYTPKTGSGSSSAAAPQTGIVEQCCTSICSLYQLENYCNGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 96 - protein, 230 aa, Artificial Sequence
  Description of Artificial Sequence: Synthetic fusion protein IN-12
FVNQHLCGSHLVEALYLVCGERGFFYTPKTGSGSSSAAAPQTGIVEQCCTSICSLYQLENYCNGGGGSGGGGSGGGGSRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE

SEQ ID NO: 97 - protein, 210 aa, Artificial Sequence
  Description of Artificial Sequence: Synthetic fusion protein IN-13
FVNQHLCGSHLVEALYLVCGERGFFGSGSSSAAAPQTGIVEQCCTSICSLYQLENYCNRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 98 - protein, 210 aa, Artificial Sequence
  Description of Artificial Sequence: Synthetic fusion protein IN-14
FVNQHLCGSHLVEALYLVCGERGFFGSGSSSAAAPQTGIVEQCCTSICSLYQLENYCNRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 99 - protein, 210 aa, Artificial Sequence
  Description of Artificial Sequence: Synthetic fusion protein IN-15
FVNQHLCGSHLVEALYLVCGERGFFGSGSSSAAAPQTGIVEQCCTSICSLYQLENYCNRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE

SEQ ID NO: 100 - protein, 215 aa, Artificial Sequence
  Description of Artificial Sequence: Synthetic fusion protein IN-16
FVNQHLCGSHLVEALYLVCGERGFFGSGSSSAAAPQTGIVEQCCTSICSLYQLENYCNGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 101 - protein, 215 aa, Artificial Sequence
  Description of Artificial Sequence: Synthetic fusion protein IN-17
FVNQHLCGSHLVEALYLVCGERGFFGSGSSSAAAPQTGIVEQCCTSICSLYQLENYCNGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 102 - protein, 215 aa, Artificial Sequence
  Description of Artificial Sequence: Synthetic fusion protein IN-18
FVNQHLCGSHLVEALYLVCGERGFFGSGSSSAAAPQTGIVEQCCTSICSLYQLENYCNGGGGSRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE

SEQ ID NO: 103 - protein, 220 aa, Artificial Sequence
  Description of Artificial Sequence: Synthetic fusion protein IN-19
FVNQHLCGSHLVEALYLVCGERGFFGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 104 - protein, 220 aa, Artificial Sequence
  Description of Artificial Sequence: Synthetic fusion protein IN-20
FVNQHLCGSHLVEALYLVCGERGFFGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 105 - protein, 220 aa, Artificial Sequence
  Description of Artificial Sequence: Synthetic fusion protein IN-21
FVNQHLCGSHLVEALYLVCGERGFFGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE

SEQ ID NO: 106 - protein, 225 aa, Artificial Sequence
  Description of Artificial Sequence: Synthetic fusion protein IN-22
FVNQHLCGSHLVEALYLVCGERGFFGSGSSSAAAPQTGIVEQCCTSICSLYQLENYCNGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 107 - protein, 225 aa, Artificial Sequence
  Description of Artificial Sequence: Synthetic fusion protein IN-23
FVNQHLCGSHLVEALYLVCGERGFFGSGSSSAAAPQTGIVEQCCTSICSLYQLENYCNGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 108 - protein, 225 aa, Artificial Sequence
  Description of Artificial Sequence: Synthetic fusion protein IN-24
FVNQHLCGSHLVEALYLVCGERGFFGSGSSSAAAPQTGIVEQCCTSICSLYQLENYCNGGGGSGGGGSGGGGSRPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDE

SEQ ID NO: 109 - protein, 225 aa, Artificial Sequence; identical to SEQ ID NO: 91
  Description of Artificial Sequence: Synthetic fusion protein IN-25
  MOD_RES (189)..(189): S-maleimide-(CH2)4-NH-(Nalpha-(HOOC(CH2)14CO)-gamma-Glu),S is the sulphur atom on the side chain of a cysteine residue

SEQ ID NO: 110 - protein, 225 aa, Artificial Sequence
  Description of Artificial Sequence: Synthetic fusion protein IN-26
  MOD_RES (157)..(157): S-CH2-CONH-(CH2CH2O)2-(CH2)2-NH-(Nalpha- (HOOC(CH2)14CO)-gamma-Glu),S is the sulphur atom on the side chain of a cysteine residue
FVNQHLCGSHLVEALYLVCGERGFFYTPKTGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 111 - protein, 220 aa, Artificial Sequence; identical to SEQ ID NO: 103
  Description of Artificial Sequence: Synthetic fusion protein IN-27
  MOD_RES (184)..(184): S-CH2-CONH-PEG20K,S is the sulphur atom on the side chain of a cysteine residue

SEQ ID NO: 112 - protein, 220 aa, Artificial Sequence
  Description of Artificial Sequence: Synthetic fusion protein IN-28
  MOD_RES (152)..(152): S-maleimide-(CH2)15-COOH,S is the sulphur atom on the side chain of a cysteine residue
FVNQHLCGSHLVEALYLVCGERGFFGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 113 - protein, 63 aa, Artificial Sequence
  Description of Artificial Sequence: Synthetic fusion protein IN-29
  MOD_RES (32)..(32): NEpsilon-PEG12-maleimide-IL-1ra,wherein the sequence of the IL-1ra has a sequence of SEQ ID NO:194, the N-hydroxylsuccinimide of the linking group, i.e. maleimide-PEG12-NHS, is reacted with the amino group on
  MOD_RES (32)..(32): the side chain of a lysine in the insulin receptor binding polypeptide, and the maleimide is reacted with the mercapto group on the side chain of a cysteine at position 116 underlined in the IL-1ra
FVNQHLCGSHLVEALYLVCGERGFFYTPRTGKGSSSAAAPQTGIVEQCCTSICSLYQLENYCN

SEQ ID NO: 114 - protein, 63 aa, Artificial Sequence; identical to SEQ ID NO: 113
  Description of Artificial Sequence: Synthetic fusion protein IN-30
  MOD_RES (32)..(32): NEpsilon-PEG12-maleimide-the interleukin-1 receptor antagonistic protein,in which the sequence of the interleukin-1 receptor antagonistic protein is SEQ ID NO:195,the N-hydroxylsuccinimide of the linking
  MOD_RES (32)..(32): group, i.e. maleimide-PEG12-NHS, is reacted with the amino group on the side chain of a lysine in the insulin receptor binding polypeptide, and the maleimide is reacted with the mercapto group on the side chain of a
  MOD_RES (32)..(32): cysteine at position 84 underlined in the interleukin-1 receptor antagonistic protein.

SEQ ID NO: 115 - protein, 63 aa, Artificial Sequence; identical to SEQ ID NO: 113
  Description of Artificial Sequence: Synthetic fusion protein IN-31
  MOD_RES (32)..(32): NEpsilon-PEG20K-maleimide-IL-1ra,in which the sequence of IL-1ra is SEQ ID NO:194 and the N-hydroxylsuccinimide of the linking group, i.e. maleimide-PEG20K-NHS, is reacted with the amino group on the side chain of a
  MOD_RES (32)..(32): lysine in the insulin receptor binding polypeptide, and the maleimide is reacted with the mercapto group on the side chain of a cysteine at position 116 underlined in the IL-1ra

SEQ ID NO: 116 - protein, 63 aa, Artificial Sequence; identical to SEQ ID NO: 113
  Description of Artificial Sequence: Synthetic fusion protein IN-32
  MOD_RES (32)..(32): NEpsilon-PEG20K-maleimide-the interleukin-1 receptor antagonistic protein,in which the sequence of the interleukin-1 receptor antagonistic protein is SEQ ID NO:195, and the N-hydroxylsuccinimide of the
  MOD_RES (32)..(32): linking group, i.e. maleimide-PEG20K-NHS, is reacted with the amino group on the side chain of a lysine in the insulin receptor binding polypeptide, and the maleimide is reacted with the mercapto group on the side
  MOD_RES (32)..(32): chain of a cysteine at position 84 underlined in the interleukin-1 receptor antagonistic protein

SEQ ID NO: 117 - protein, 63 aa, Artificial Sequence; identical to SEQ ID NO: 113
  Description of Artificial Sequence: Synthetic fusion protein IN-33
  MOD_RES (1)..(1): Nalpha-(Nalpha-(HOOC(CH2)14CO)-gamma-L-Glu)
  MOD_RES (32)..(32): NEpsilon-PEG12-maleimide-IL-1ra,in which the sequence of IL-1ra is SEQ ID NO:194 and the N-hydroxylsuccinimide of the linking group, i.e. maleimide-PEG12-NHS, is reacted with the amino group on the side chain of a
  MOD_RES (32)..(32): lysine in the insulin receptor binding polypeptide, and the maleimide is reacted with the mercapto group on the side chain of a cysteine at position 116 underlined in the IL-1ra

SEQ ID NO: 118 - protein, 63 aa, Artificial Sequence; identical to SEQ ID NO: 113
  Description of Artificial Sequence: Synthetic fusion protein IN-34
  MOD_RES (1)..(1): Nalpha-(Nalpha-(HOOC(CH2)16CO)-gamma-L-Glu)
  MOD_RES (32)..(32): NEpsilon-PEG12-maleimide-the interleukin-1 receptor antagonistic protein,in which the sequence of the interleukin-1 receptor antagonistic protein is SEQ ID NO:195, and the N-hydroxylsuccinimide of the
  MOD_RES (32)..(32): linking group, i.e. maleimide-PEG12-NHS, is reacted with the amino group on the side chain of a lysine in the insulin receptor binding polypeptide, and the maleimide is reacted with the mercapto group on the side chain of
  MOD_RES (32)..(32): a cysteine at position 84 underlined in the interleukin-1 receptor antagonistic protein

SEQ ID NO: 119 - protein, 152 aa, Artificial Sequence; identical to SEQ ID NO: 52
  Description of Artificial Sequence: Synthetic fusion protein IN-35
  MOD_RES (116)..(116): S-maleimide-PEG12-human insulin,S is the sulphur atom on the side chain of a cysteine residue

SEQ ID NO: 120 - protein, 152 aa, Artificial Sequence; identical to SEQ ID NO: 52
  Description of Artificial Sequence: Synthetic fusion protein IN-36
  MOD_RES (116)..(116): S-maleimide-PEG12-the insulin receptor binding polypeptide,S is the sulphur atom on the side chain of a cysteine residue

SEQ ID NO: 121 - protein, 152 aa, Artificial Sequence; identical to SEQ ID NO: 52
  Description of Artificial Sequence: Synthetic fusion protein IN-37
  MOD_RES (116)..(116): S-maleimide-PEG20K-human insulin,S is the sulphur atom on the side chain of a cysteine residue

SEQ ID NO: 122 - protein, 152 aa, Artificial Sequence; identical to SEQ ID NO: 51
  Description of Artificial Sequence: Synthetic fusion protein IN-38
  MOD_RES (84)..(84): S-maleimide-PEG 12-human insulin,S is the sulphur atom on the side chain of a cysteine residue

SEQ ID NO: 123 - protein, 152 aa, Artificial Sequence; identical to SEQ ID NO: 51
  Description of Artificial Sequence: Synthetic fusion protein IN-39
  MOD_RES (84)..(84): S-maleimide-PEG 20K-human insulin,S is the sulphur atom on the side chain of a cysteine residue

SEQ ID NO: 124 - protein, 152 aa, Artificial Sequence; identical to SEQ ID NO: 51
  Description of Artificial Sequence: Synthetic fusion protein IN-40
  MOD_RES (84)..(84): S-maleimide-PEG12-the insulin receptor binding polypeptide,S is the sulphur atom on the side chain of a cysteine residue

SEQ ID NO: 125 - protein, 152 aa, Artificial Sequence; identical to SEQ ID NO: 52
  Description of Artificial Sequence: Synthetic fusion protein IN-41
  MOD_RES (116)..(116): S-maleimide-PEG12-human insulin desB30T,S is the sulphur atom on the side chain of a cysteine residue

SEQ ID NO: 126 - protein, 152 aa, Artificial Sequence; identical to SEQ ID NO: 52
  Description of Artificial Sequence: Synthetic fusion protein IN-42
  MOD_RES (116)..(116): S-maleimide-PEG20K-human insulin desB30T,S is the sulphur atom on the side chain of a cysteine residue

SEQ ID NO: 127 - protein, 152 aa, Artificial Sequence; identical to SEQ ID NO: 51
  Description of Artificial Sequence: Synthetic fusion protein IN-43
  MOD_RES (84)..(84): S-maleimide-PEG 12-human insulin desB30T,S is the sulphur atom on the side chain of a cysteine residue

SEQ ID NO: 128 - protein, 152 aa, Artificial Sequence; identical to SEQ ID NO: 51
  Description of Artificial Sequence: Synthetic fusion protein IN-44
  MOD_RES (84)..(84): S-maleimide-PEG 20K -human insulin desB30T,S is the sulphur atom on the side chain of a cysteine residue

SEQ ID NO: 129 - protein, 64 aa, Artificial Sequence
  Description of Artificial Sequence: Synthetic fusion protein IN-45
  MOD_RES (64)..(64): NEpsilon-PEG12-maleimide-IL-1ra, wherein the sequence of the IL-1ra is SEQ ID NO:194
FVNQHLCGSHLVEALYLVCGERGFFYTPRTGSGSSSAAAPQTGIVEQCCTSICSLYQLENYCNK

SEQ ID NO: 130 - protein, 64 aa, Artificial Sequence; identical to SEQ ID NO: 129
  Description of Artificial Sequence: Synthetic fusion protein IN-46
  MOD_RES (64)..(64): NEpsilon-PEG20K-maleimide-IL-1ra,wherein the sequence of the IL-1ra is SEQ ID NO:194

SEQ ID NO: 131 - protein, 64 aa, Artificial Sequence; identical to SEQ ID NO: 129
  Description of Artificial Sequence: Synthetic fusion protein IN-47
  MOD_RES (64)..(64): NEpsilon-PEG12-maleimide-the interleukin-1 receptor antagonistic protein,the sequence of the interleukin-1 receptor antagonistic protein is SEQ ID NO:195

SEQ ID NO: 132 - protein, 64 aa, Artificial Sequence; identical to SEQ ID NO: 129
  Description of Artificial Sequence: Synthetic fusion protein IN-48
  MOD_RES (64)..(64): NEpsilon-PEG20K-maleimide-the interleukin-1 receptor antagonistic protein,the sequence of the interleukin-1 receptor antagonistic protein is SEQ ID NO:195

SEQ ID NO: 133 - protein, 63 aa, Artificial Sequence
  Description of Artificial Sequence: Synthetic fusion protein IN-49
  MOD_RES (1)..(1): Nalpha-PEG12-maleimide-IL-1ra,wherein the sequence of the IL-1ra is SEQ ID NO: 196
FVNQHLCGSHLVEALYLVCGERGFFYTPRTGSGSSSAAAPQTGIVEQCCTSICSLYQLENYCN

SEQ ID NO: 134 - protein, 63 aa, Artificial Sequence; identical to SEQ ID NO: 133
  Description of Artificial Sequence: Synthetic fusion protein IN-50
  MOD_RES (1)..(1): Nalpha-PEG20K-maleimide-IL-1ra,,wherein the sequence of the IL-1ra is SEQ ID NO:196

SEQ ID NO: 135 - protein, 63 aa, Artificial Sequence; identical to SEQ ID NO: 113
  Description of Artificial Sequence: Synthetic fusion protein IN-51
  MOD_RES (32)..(32): NEpsilon-PEG12-maleimide-the interleukin-1 receptor antagonistic protein,in which the sequence of the interleukin-1 receptor antagonistic protein is SEQ ID NO: 196

SEQ ID NO: 136 - protein, 63 aa, Artificial Sequence; identical to SEQ ID NO: 113
  Description of Artificial Sequence: Synthetic fusion protein IN-52
  MOD_RES (32)..(32): NEpsilon-PEG20K-maleimide-the interleukin-1 receptor antagonistic protein,in which the sequence of the interleukin-1 receptor antagonistic protein is SEQ ID NO: 196

SEQ ID NO: 137 - protein, 63 aa, Artificial Sequence
  Description of Artificial Sequence: Synthetic fusion protein IN-53
  MOD_RES (38)..(38): NEpsilon-PEG12-maleimide-the interleukin-1 receptor antagonistic protein,in which the sequence of the interleukin-1 receptor antagonistic protein is SEQ ID NO: 196
FVNQHLCGSHLVEALYLVCGERGFFYTPRTGSGSSSAKAPQTGIVEQCCTSICSLYQLENYCN

SEQ ID NO: 138 - protein, 63 aa, Artificial Sequence; identical to SEQ ID NO: 137
  Description of Artificial Sequence: Synthetic fusion protein IN-54
  MOD_RES (38)..(38): NEpsilon-PEG20K-maleimide-the interleukin-1 receptor antagonistic protein, in which the sequence of the interleukin-1 receptor antagonistic protein is SEQ ID NO: 196

SEQ ID NO: 139 - protein, 58 aa, Artificial Sequence
  Description of Artificial Sequence: Synthetic fusion protein IN-55
  MOD_RES (33)..(33): NEpsilon-PEG12-maleimide-IL-1ra, in which the sequence of the IL-1ra is SEQ ID NO:194
FVNQHLCGSHLVEALYLVCGERGFFGSGSSSAKAPQTGIVEQCCTSICSLYQLENYCN

SEQ ID NO: 140 - protein, 58 aa, Artificial Sequence; identical to SEQ ID NO: 139
  Description of Artificial Sequence: Synthetic fusion protein IN-56
  MOD_RES (33)..(33): NEpsilon-PEG12-maleimide-the interleukin-1 receptor antagonistic protein, in which the sequence of the interleukin-1 receptor antagonistic protein is SEQ ID NO:195

SEQ ID NO: 141 - protein, 153 aa, Artificial Sequence; identical to SEQ ID NO: 67
  Description of Artificial Sequence: Synthetic fusion protein IN-57
  MOD_RES (1)..(1): S-maleimide-PEG12-human insulin,S is the sulphur atom on the side chain of a cysteine residue

SEQ ID NO: 142 - protein, 153 aa, Artificial Sequence; identical to SEQ ID NO: 67
  Description of Artificial Sequence: Synthetic fusion protein IN-58
  MOD_RES (1)..(1): S-maleimide-PEG12-the insulin receptor binding polypeptide,S is the sulphur atom on the side chain of a cysteine residue

SEQ ID NO: 143 - protein, 153 aa, Artificial Sequence; identical to SEQ ID NO: 67
  Description of Artificial Sequence: Synthetic fusion protein IN-59
  MOD_RES (1)..(1): S-maleimide-PEG12-human insulin desB30T,S is the sulphur atom on the side chain of a cysteine residue

SEQ ID NO: 144 - protein, 154 aa, Artificial Sequence
  Description of Artificial Sequence: Synthetic fusion protein IN-60
  MOD_RES (154)..(154): S-maleimide-PEG12-human insulin,S is the sulphur atom on the side chain of a cysteine residue
MRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDEC

SEQ ID NO: 145 - protein, 154 aa, Artificial Sequence; identical to SEQ ID NO: 144
  Description of Artificial Sequence: Synthetic fusion protein IN-61
  MOD_RES (154)..(154): S-maleimide-PEG12-human insulin desB30T,S is the sulphur atom on the side chain of a cysteine residue

SEQ ID NO: 146 - protein, 225 aa, Artificial Sequence
  Description of Artificial Sequence: Synthetic fusion protein IN-62
RPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSFVNQHLCGSHLVEALYLVCGERGFFYTPKTGSGSSSAAAPQTGIVEQCCTSICSLYQLENYCN

SEQ ID NO: 147 - protein, 225 aa, Artificial Sequence
  Description of Artificial Sequence: Synthetic fusion protein IN-63
RPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDEGGGGSGGGGSFVNQHLCGSHLVEALYLVCGERGFFYTPKTGSGSSSAAAPQTGIVEQCCTSICSLYQLENYCN

SEQ ID NO: 148 - protein, 225 aa, Artificial Sequence
  Description of Artificial Sequence: Synthetic fusion protein IN-64
RPSGRKSSKMQAFRIWDVNQKTFYLRNNQLVAGYLQGPNVNLEEKIDVVPIEPHALFLGIHGGKMSLSSVKSGDETRLQLEAVNITDLSENRKQDKRFAFIRSDSGPTTSFESAASPGWFLSTAMEADQPVSLTNMPDEGVMVTKFYFQEDEGGGGSGGGGSFVNQHLCGSHLVEALYLVCGERGFFYTPKTGSGSSSAAAPQTGIVEQCCTSICSLYQLENYCN

SEQ ID NO: 149 - protein, 225 aa, Artificial Sequence
  Description of Artificial Sequence: Synthetic fusion protein IN-65
RPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDEGGGGSGGGGSFVNQHLCGSHLVEALYLVCGERGFFYTPKTGSGSSSAAAPQTGIVEQCCTSICSLYQLENYCN

SEQ ID NO: 150 - protein, 232 aa, Artificial Sequence
  Description of Artificial Sequence: Synthetic fusion protein IN-66
MRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDEGGGGSCGGGGSGGGGSFVNQHLCGSHLVEALYLVCGERGFFYTPKTGSGSSSAAAPQTGIVEQCCTSICSLYQLENYCN

SEQ ID NO: 151 - protein, 231 aa, Artificial Sequence
  Description of Artificial Sequence: Synthetic fusion protein IN-67
FVNQHLCGSHLVEALYLVCGERGFFYTPKTGSGSSSAAAPQTGIVEQCCTSICSLYQLENYCNGGGGSGGGGSCGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 152 - protein, 820 aa, Artificial Sequence
  Description of Artificial Sequence: Synthetic fusion protein IN-68
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSFVNQHLCGSHLVEALYLVCGERGFFYTPKTGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 153 - protein, 820 aa, Artificial Sequence
  Description of Artificial Sequence: Synthetic fusion protein IN-69
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSFVNQHLCGSHLVEALYLVCGERGFFYTPKTGSGSSSAAAPQTGIVEQCCTSICSLYQLENYCN

SEQ ID NO: 154 - protein, 821 aa, Artificial Sequence
  Description of Artificial Sequence: Synthetic fusion protein IN-70
MRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSFVNQHLCGSHLVEALYLVCGERGFFYTPKTGAGSSSAAAPQTGIVEQCCTSICSLYQLENYCN

SEQ ID NO: 155 - protein, 199 aa, Artificial Sequence
  Description of Artificial Sequence: Synthetic fusion protein GI-1
YSEGTFISDYSIAMDKIHQQDFVNWLLAQKGKKNDWKHNITQGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 156 - protein, 194 aa, Artificial Sequence
  Description of Artificial Sequence: Synthetic fusion protein GI-2
YAEGTFISDYSIAMDKIHQQDFVNWLLAQKGKKNDWKHNITQRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 157 - protein, 199 aa, Artificial Sequence
  Description of Artificial Sequence: Synthetic fusion protein GI-3
YAEGTFISDYSIAMDKIHQQDFVNWLLAQKGKKNDWKHNITQGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 158 - protein, 204 aa, Artificial Sequence
  Description of Artificial Sequence: Synthetic fusion protein GI-4
YAEGTFISDYSIAMDKIHQQDFVNWLLAQKGKKNDWKHNITQGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 159 - protein, 209 aa, Artificial Sequence
  Description of Artificial Sequence: Synthetic fusion protein GI-5
YAEGTFISDYSIAMDKIHQQDFVNWLLAQKGKKNDWKHNITQGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 160 - protein, 194 aa, Artificial Sequence
  Description of Artificial Sequence: Synthetic fusion protein GI-6
YAPGTFISDYSIAMDKIHQQDFVNWLLAQKGKKNDWKHNITQRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 161 - protein, 199 aa, Artificial Sequence
  Description of Artificial Sequence: Synthetic fusion protein GI-7
YAPGTFISDYSIAMDKIHQQDFVNWLLAQKGKKNDWKHNITQGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 162 - protein, 204 aa, Artificial Sequence
  Description of Artificial Sequence: Synthetic fusion protein GI-8
YAPGTFISDYSIAMDKIHQQDFVNWLLAQKGKKNDWKHNITQGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 163 - protein, 209 aa, Artificial Sequence
  Description of Artificial Sequence: Synthetic fusion protein GI-9
YAPGTFISDYSIAMDKIHQQDFVNWLLAQKGKKNDWKHNITQGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 164 - protein, 195 aa, Artificial Sequence
  Description of Artificial Sequence: Synthetic fusion protein IN-10
ISDYSIAMDKIHQQDFVNWLLAQKPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 165 - protein, 206 aa, Artificial Sequence
  Description of Artificial Sequence: Synthetic fusion protein GI-11
YGEGTFISDYSIAMDKIHQQDFVNWLLAQKPSSGAPPPSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 166 - protein, 196 aa, Artificial Sequence
  Description of Artificial Sequence: Synthetic fusion protein GI-12
YGEGTFISDYSIAMDKIHQQDFVNWLLAQKPSSGAPPPSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 167 - protein, 206 aa, Artificial Sequence
  Description of Artificial Sequence: Synthetic fusion protein GI-13
YAEGTFISDYSIAMDKIHQQDFVNWLLAQKPSSGAPPPSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 168 - protein, 201 aa, Artificial Sequence
  Description of Artificial Sequence: Synthetic fusion protein GI-14
YAEGTFISDYSIAMDKIHQQDFVNWLLAQKPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 169 - protein, 196 aa, Artificial Sequence
  Description of Artificial Sequence: Synthetic fusion protein GI-15
YAEGTFISDYSIAMDKIHQQDFVNWLLAQKPSSGAPPPSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 170 - protein, 187 aa, Artificial Sequence
  Description of Artificial Sequence: Synthetic fusion protein GI-16
FISDYSIAMDKIHQQDFVNWLLAQKGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 171 - protein, 182 aa, Artificial Sequence
  Description of Artificial Sequence: Synthetic fusion protein GI-17
FISDYSIAMDKIHQQDFVNWLLAQKGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 172 - protein, 196 aa, Artificial Sequence
  Description of Artificial Sequence: Synthetic fusion protein GI-18
FISDYSIAMDKIHQQDFVNWLLAQKPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 173 - protein, 182 aa, Artificial Sequence
  Description of Artificial Sequence: Synthetic fusion protein GI-19
YAPGTFISDYSIAMDKIHQQDFVNWLLAQKRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 174 - protein, 196 aa, Artificial Sequence
  Description of Artificial Sequence: Synthetic fusion protein GI-20
YAPGTFISDYSIAMDKIHQQDFVNWLLAQKPSSGAPPPSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 175 - protein, 201 aa, Artificial Sequence
  Description of Artificial Sequence: Synthetic fusion protein GI-21
YAPGTFISDYSIAMDKIHQQDFVNWLLAQKPSSGAPPPSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 176 - protein, 789 aa, Artificial Sequence
  Description of Artificial Sequence: Synthetic fusion protein GI-22
YAEGTFISDYSIAMDKIHQQDFVNWLLAQKGKKNDWKHNITQGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 177 - protein, 789 aa, Artificial Sequence
  Description of Artificial Sequence: Synthetic fusion protein GI-23
YAPGTFISDYSIAMDKIHQQDFVNWLLAQKGKKNDWKHNITQGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 178 - protein, 153 aa, Artificial Sequence
  Description of Artificial Sequence: Synthetic fusion protein GI-24
  MOD_RES (85)..(85): S-maleimide-PEG11-maleimide-S-GIP receptor binding polypeptide,S is the sulphur atom on the side chain of a cysteine residue, wherein the GIP receptor binding polypeptide has a sequence of SEQ ID NO: 197
MRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 179 - protein, 152 aa, Artificial Sequence; identical to SEQ ID NO: 52
  Description of Artificial Sequence: Synthetic fusion protein GI-25
  MOD_RES (116)..(116): S-maleimide-PEG40K -maleimide-S-GIP receptor binding polypeptide,S is the sulphur atom on the side chain of a cysteine residue; wherein the GIP receptor binding polypeptide has a sequence of SEQ ID NO: 198

SEQ ID NO: 180 - protein, 152 aa, Artificial Sequence; identical to SEQ ID NO: 52
  Description of Artificial Sequence: Synthetic fusion protein GI-26
  MOD_RES (116)..(116): S-maleimide-PEG40K -maleimide-S-GIP receptor binding polypeptide,S is the sulphur atom on the side chain of a cysteine residue; wherein the GIP receptor binding polypeptide has a sequence of SEQ ID NO: 199

SEQ ID NO: 181 - protein, 154 aa, Artificial Sequence; identical to SEQ ID NO: 144
  Description of Artificial Sequence: Synthetic fusion protein GI-27
  MOD_RES (154)..(154): S-maleimide-PEG11-maleimide-S-GIP receptor binding polypeptide, S is the sulphur atom on the side chain of a cysteine residue,wherein the sequence of the GIP receptor binding polypeptide is SEQ ID NO:200

SEQ ID NO: 182 - protein, 153 aa, Artificial Sequence
  Description of Artificial Sequence: Synthetic fusion protein GI-28
  MOD_RES (1)..(1): S-maleimide-PEG11-maleimide-S-GIP receptor binding polypeptide,S is the sulphur atom on the side chain of a cysteine residue,wherein the GIP receptor binding polypeptide has a sequence of SEQ ID NO:201
  MOD_RES (117)..(117): S-CH2-CONH-(CH2CH2O)4-(CH2)2-NH-(Nalpha-(HOOC(CH2)16CO) -gamma-Glu)
CRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 183 - protein, 153 aa, Artificial Sequence; identical to SEQ ID NO: 178
  Description of Artificial Sequence: Synthetic fusion protein GI-29
  MOD_RES (85)..(85): S-maleimide-PEG40K-maleimide-S-GIP receptor binding polypeptide,S is the sulphur atom on the side chain of a cysteine residue,wherein the GIP receptor binding polypeptide has a sequence of SEQ ID NO:202

SEQ ID NO: 184 - protein, 152 aa, Artificial Sequence; identical to SEQ ID NO: 52
  Description of Artificial Sequence: Synthetic fusion protein GI-30
  MOD_RES (116)..(116): S-maleimide-PEG11-maleimide-S-GIP receptor binding polypeptide,S is the sulphur atom on the side chain of a cysteine residue, wherein the GIP receptor binding polypeptide has a sequence of SEQ ID NO:203

SEQ ID NO: 185 - protein, 39 aa, Unknown
  Description of Unknown: GLP-1 receptor binding polypeptide
HGEGTFTSDLSKQMEEEAVRLFIEWLKNGGPSSGAPPPC

SEQ ID NO: 186 - protein, 31 aa, Unknown
  Description of Unknown: GLP-1 receptor binding polypeptide
HGEGTFTSDVSSYLEEQAAKEFIAWLVKGRC

SEQ ID NO: 187 - protein, 31 aa, Unknown
  Description of Unknown: GLP-1 receptor binding polypeptide
HGEGTFTSDVSSYLEEQAAKEFIAWLVCGRG

SEQ ID NO: 188 - protein, 39 aa, Unknown
  Description of Unknown: GLP-1 receptor binding polypeptide
HGEGTFTSDLSKQMEEEAVRLFIEWLCNGGPSSGAPPPS

SEQ ID NO: 189 - protein, 31 aa, Unknown
  Description of Unknown: GLP-1 receptor binding polypeptide
  MOD_RES (2)..(2): 2-methyl-alanine
HXEGTFTSDVSSYLEGQAAKEFIAWLVKGRC

SEQ ID NO: 190 - protein, 31 aa, Unknown
  Description of Unknown: GLP-1 receptor binding polypeptide
  MOD_RES (2)..(2): 2-methyl-alanine
HXEGTFTSDVSSYLEGQAAKEFIAWLVCGRG

SEQ ID NO: 191 - protein, 31 aa, Unknown
  Description of Unknown: GLP-1 receptor binding polypeptide
  MOD_RES (2)..(2): 2-methyl-alanine
HXEGTFTSDVSSYLEEQAAKEFIAWLVKGRC

SEQ ID NO: 192 - protein, 31 aa, Unknown
  Description of Unknown: GLP-1 receptor binding polypeptide
  MOD_RES (2)..(2): 2-methyl-alanine
HXEGTFTSDVSSYLEGQAACEFIAWLVKGRG

SEQ ID NO: 193 - protein, 31 aa, Unknown
  Description of Unknown: GLP-1 receptor binding polypeptide
  MOD_RES (20)..(20): NEpsilon-(Nalpha-(HOOC(CH2)14CO)-gamma-L-Glu)
HAEGTFTSDVSSYLEGQAAKEFIAWLVRGRC

SEQ ID NO: 194 - protein, 152 aa, Unknown; identical to SEQ ID NO: 52
  Description of Unknown: IL-1ra polypeptide

SEQ ID NO: 195 - protein, 152 aa, Unknown; identical to SEQ ID NO: 51
  Description of Unknown: interleukin-1 receptor antagonistic protein

SEQ ID NO: 196 - protein, 153 aa, Unknown; identical to SEQ ID NO: 67
  Description of Unknown: IL-1ra

SEQ ID NO: 197 - protein, 42 aa, Unknown
  Description of Unknown: GIP receptor binding polypeptide
YAEGTFISDYSIAMDKIHQQDFVNWLLAQKGKKNDWCHNITQ

SEQ ID NO: 198 - protein, 43 aa, Unknown
  Description of Unknown: GIP receptor binding polypeptide
YAEGTFISDYSIAMDKIHQQDFVNWLLAQKGKKNDWKHNITQC

SEQ ID NO: 199 - protein, 43 aa, Unknown
  Description of Unknown: GIP receptor binding polypeptide
YAPGTFISDYSIAMDKIHQQDFVNWLLAQKGKKNDWKHNITQC

SEQ ID NO: 200 - protein, 30 aa, Unknown
  Description of Unknown: GIP receptor binding polypeptide
  MOD_RES (2)..(2): 2-methyl-alanine
YXEGTFISDYSIAMDKIHQQDFVNWLLAQC

SEQ ID NO: 201 - protein, 40 aa, Unknown
  Description of Unknown: GIP receptor binding polypeptide
  MOD_RES (2)..(2): 2-methyl-alanine
YXEGTFISDYSIAMDKIHQQDFVNWLLAQKPSSGAPPPSC

SEQ ID NO: 202 - protein, 39 aa, Unknown
  Description of Unknown: GIP receptor binding polypeptide
YAEGTFISDYSIAMDKIHQQDFVNWLLAQKPSSGAPPPC

SEQ ID NO: 203 - protein, 26 aa, Unknown
  Description of Unknown: GIP receptor binding polypeptide
FISDYSIAMDKIHQQDFVNWLLAQKC

SEQ ID NO: 204 - protein, 153 aa, Unknown
  Description of Unknown: interleukin-1 receptor antagonistic protein or an analogue thereof
  MOD_RES (1)..(1): methionine, a cysteine, general formula 1, general formula 2, or absent
  MOD_RES (67)..(67): cysteine or serine
  MOD_RES (70)..(70): cysteine or serine
  MOD_RES (85)..(85): cysteine or asparagine
  MOD_RES (117)..(117): cysteine or serine
  MOD_RES (123)..(123): cysteine or serine
XRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDE

SEQ ID NO: 205 - protein, 30 aa, Homo sapiens
  human GLP-1 (7-36)
HAEGTFTSDVSSYLEGQAAKEFIAWLVKGR

SEQ ID NO: 206 - protein, 31 aa, Homo sapiens
  human GLP-1 (7-37)
HAEGTFTSDVSSYLEGQAAKEFIAWLVKGRG

SEQ ID NO: 207 - protein, 31 aa, Unknown
  Description of Unknown: GLP-1 receptor antagonist
DLSKQMEEEAVRLFIEWLKNGGPSSGAPPPS

SEQ ID NO: 208 - protein, 30 aa, Unknown
  Description of Unknown: GLP-1 receptor antagonist
HAKGTFTSDVSSYLEGQAAKEFIAWLVKGR

SEQ ID NO: 209 - protein, 28 aa, Unknown
  Description of Unknown: GLP-1 receptor antagonist
EGTFTSDVSSYLEGQAAKEFIAWLVKGR

SEQ ID NO: 210 - protein, 29 aa, Unknown
  Description of Unknown: GLP-1 receptor antagonist
AEGTFTSEVSSYLEGQAAKEFIAWLVKGR

SEQ ID NO: 211 - protein, 31 aa, Unknown
  Description of Unknown: Liraglutide peptide
HAEGTFTSDVSSYLEGQAAKEFIAWLVRGRG

SEQ ID NO: 212 - protein, 44 aa, Unknown
  Description of Unknown: Lixisenatide polypeptide
HGEGTFTSDLSKQMEEEAVRLFIEWLKNGGPSSGAPPSKKKKKK

SEQ ID NO: 213 - protein, 27 aa, Unknown
  Description of Unknown: Taspoglutide peptide
HEGTFTSDVSSYLEGQAAKEFIAWLVK

SEQ ID NO: 214 - protein, 39 aa, Unknown
  Description of Unknown: Exenatide peptide
HGEGTFTSDLSKQMEEEAVRLFIEWLKNGGPSSGAPPPS

SEQ ID NO: 215 - protein, 39 aa, Unknown
  Description of Unknown: Exendin-3 peptide
HSDGTFTSDLSKQMEEEAVRLFIEWLKNGGPSSGAPPPS

SEQ ID NO: 216 - protein, 42 aa, Homo sapiens
YAEGTFISDYSIAMDKIHQQDFVNWLLAQKGKKNDWKHNITQ

SEQ ID NO: 217 - protein, 153 aa, Homo sapiens
MRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 218 - protein, 152 aa, Homo sapiens; identical to SEQ ID NO: 52

SEQ ID NO: 219 - protein, 153 aa, Unknown; identical to SEQ ID NO: 67
  Description of Unknown: IL-1ra analogue

SEQ ID NO: 220 - protein, 153 aa, Unknown; identical to SEQ ID NO: 182
  Description of Unknown: IL-1ra analogue

SEQ ID NO: 221 - protein, 153 aa, Unknown
  Description of Unknown: IL-1ra analogue
CRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 222 - protein, 152 aa, Unknown; identical to SEQ ID NO: 51
  Description of Unknown: IL-1ra analogue

SEQ ID NO: 223 - protein, 152 aa, Unknown
  Description of Unknown: IL-1ra analogue
RPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAACPGWFLCTAMEADQPVSLTNMPDEGVMVTKFYFQEDE

SEQ ID NO: 224 - protein, 152 aa, Unknown
  Description of Unknown: IL-1ra analogue
RPSGRCSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 225 - protein, 152 aa, Unknown
  Description of Unknown: IL-1ra analogue
RPSGRCSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 226 - protein, 152 aa, Unknown
  Description of Unknown: IL-1ra analogue
RPSGRKSCKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 227 - protein, 152 aa, Unknown
  Description of Unknown: IL-1ra analogue
RPSGRKSCKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 228 - protein, 152 aa, Unknown
  Description of Unknown: IL-1ra analogue
RPSGRKSSCMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGVMVTKFYFQEDE

SEQ ID NO: 229 - protein, 152 aa, Unknown
  Description of Unknown: IL-1ra analogue
RPSGRKSSCMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 230 - protein, 152 aa, Unknown
  Description of Unknown: IL-1ra analogue
RPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAASPGWFLCTAMEADQPVSLTNMPDEGCMVTKFYFQEDE

SEQ ID NO: 231 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine, alpha-methyl-histidine,
  MOD_RES (1)..(1): 2-pyridinyl-alanine, 3-pyridinyl-alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, 2-methylalanine (Aib), glycine, D-serine, serine, threonine, aminocycloheptanecarboxylic acid, or aminocyclooctanecarboxylic acid
  MOD_RES (3)..(3): glutamic acid, aspartic acid, or glutamine
  MOD_RES (5)..(5): threonine, aspartic acid, glutamic acid, arginine, alanine, lysine, or histidine
  MOD_RES (6)..(6): phenylalanine, tyrosine, tryptophan, or histidine
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (17)..(17): glutamine, arginine, isoleucine, glutamic acid, aspartic acid, histidine, lysine, cysteine, general formula 1, or general formula 2
  MOD_RES (18)..(18): alanine, arginine, histidine, glutamic acid, or lysine
  MOD_RES (20)..(20): lysine, arginine, aspartic acid, glutamic acid, glutamine, histidine, 2-methylalanine, cysteine, general formula 1, or general formula 2
  MOD_RES (21)..(21): aspartic acid, glutamic acid, leucine, alanine, lysine, cysteine, general formula 1, or general formula 2
  MOD_RES (24)..(24): alanine, glutamine, asparagine, glutamic acid, aspartic acid, serine, or histidine
  MOD_RES (25)..(25): alanine, tryptophan, phenylalanine, tyrosine, cysteine, lysine, general formula 1, or general formula 2
  MOD_RES (27)..(27): valine, leucine, lysine, arginine, alanine, glycine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXXGXXTSDXSXYLEXXXAXXFIXXLXXXXX

SEQ ID NO: 232 - protein, 31 aa, Unknown
  Description of Unknown: GLP-1 receptor binding polypeptide
  MOD_RES (2)..(2): Xaa can be any naturally occurring amino acid
  MOD_RES (10)..(10): Xaa can be any naturally occurring amino acid
  MOD_RES (16)..(16): Xaa can be any naturally occurring amino acid
  MOD_RES (20)..(20): Xaa can be any naturally occurring amino acid
  MOD_RES (28)..(28): Xaa can be any naturally occurring amino acid
  MOD_RES (31)..(31): Xaa can be any naturally occurring amino acid
HXEGTFTSDXSSYLEXQAAXEFIAWLVXGRX

SEQ ID NO: 233 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (3)..(3): aspartic acid, glutamic acid, or glutamine
  MOD_RES (6)..(6): phenylalanine, alanine, tyrosine, or naphthylalanine
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (13)..(13): glutamine, alanine, or tyrosine
  MOD_RES (14)..(14): methionine, leucine, norleucine, isoleucine, alanine, valine, or general formula 1, or general formula 2
  MOD_RES (16)..(16): glutamic acid, aspartic acid, serine, glycine, lysine, or arginine
  MOD_RES (17)..(17): glutamic acid, glutamine, arginine, or isoleucine
  MOD_RES (19)..(19): valine, alanine, or glutamine
  MOD_RES (20)..(20): lysine, glutamine, cysteine, arginine, general formula 1, or general formula 2
  MOD_RES (21)..(21): leucine, glutamic acid, or aspartic acid
  MOD_RES (23)..(23): isoleucine, leucine, valine, pentaglycine
  MOD_RES (24)..(24): alanine, glutamic acid, aspartic acid, asparagine, or glutamine
  MOD_RES (25)..(25): alanine, tryptophan, phenylalanine, tyrosine, cysteine, lysine, naphthylalanine, general formula 1, or general formula2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(31): -NH2, glycine, proline, homoproline, thioproline, N-alkyl alanine, or absent
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (34)..(34): glycine, absent, general formula 1, or general formula 2
  MOD_RES (35)..(35): alanine, lysine, cysteine, general formula 1, general formula 2, or absent
  MOD_RES (36)..(36): proline, homoproline, thioproline, N-alkyl alanine, or absent
  MOD_RES (37)..(37): proline, homoproline, thioproline, N-alkyl alanine, or absent
  MOD_RES (38)..(38): proline, homoproline, thioproline, N-alkylalanine, or absent
  MOD_RES (39)..(39): serine, serine-NH2, cysteine, cysteine-NH2, lysine, lysine-NH2, or absent or is a linking or spacer group + XE40, ,XE40 is a lysine, cysteine, general formula 3, or general formula 4
XXXGTXTSDXSXXXEXXAXXXFXXXLXXXXXXXXXXXXX

SEQ ID NO: 234 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine, alpha-methyl-histidine, 2-pyridinyl-
  MOD_RES (1)..(1): alanine, 3-pyridinyl-alanine, 4-pyridinyl-alanine, imidazopropionyl, arginine, or tyrosine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(31): -NH2, glycine, proline, homoproline, thioproline, N-alkyl alanine, or absent
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (34)..(34): glycine, absent, general formula 1, or general formula 2
  MOD_RES (35)..(35): alanine, lysine, cysteine, general formula 1, general formula 2, or absent
  MOD_RES (36)..(36): proline, homoproline, thioproline, N-alkyl alanine, or absent
  MOD_RES (37)..(37): proline, homoproline, thioproline, N-alkyl alanine, or absent
  MOD_RES (38)..(38): proline, homoproline, thioproline, N-alkylalanine, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XGEGTFTSDLSXQXEEEAVXLFIEWLXXXXXXXXXXXXX

SEQ ID NO: 235 - protein, 192 aa, Artificial Sequence
  Description of Artificial Sequence: Synthetic fusion protein
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine, alpha-methyl-histidine, 2-
  MOD_RES (1)..(1): pyridinyl-alanine, 3-pyridinyl-alanine, 4-pyridinyl- alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutane- carboxylic acid, aminocyclopentanecarboxylic acid,
  MOD_RES (2)..(2): aminocyclohexanecarboxylic acid, aminocycloheptane- carboxylic acid, or aminocyclooctanecarboxylic acid
  MOD_RES (3)..(3): aspartic acid, glutamic acid, or glutamine
  MOD_RES (6)..(6): phenylalanine, alanine, tyrosine, or naphthylalanine
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (13)..(13): glutamine, alanine, or tyrosine
  MOD_RES (14)..(14): methionine, leucine, norleucine, isoleucine, alanine, valine, or general formula 1, or general formula 2
  MOD_RES (16)..(16): glutamic acid, aspartic acid, serine, glycine, lysine, or arginine
  MOD_RES (17)..(17): glutamic acid, glutamine, arginine, or isoleucine
  MOD_RES (19)..(19): valine, alanine, or glutamine
  MOD_RES (20)..(20): lysine, glutamine, cysteine, arginine, general formula 1, or general formula 2
  MOD_RES (21)..(21): leucine, glutamic acid, or aspartic acid
  MOD_RES (23)..(23): isoleucine, leucine, valine, pentaglycine
  MOD_RES (24)..(24): alanine, glutamic acid, aspartic acid, asparagine, or glutamine
  MOD_RES (25)..(25): alanine, tryptophan, phenylalanine, tyrosine, cysteine, lysine, naphthylalanine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(31): -NH2, glycine, proline, homoproline, thioproline, N-alkyl alanine, or absent
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (34)..(34): glycine, absent, general formula 1, or general formula 2
  MOD_RES (35)..(35): alanine, lysine, cysteine, general formula 1, general formula 2, or absent
  MOD_RES (36)..(36): proline, homoproline, thioproline, N-alkyl alanine, or absent
  MOD_RES (37)..(37): proline, homoproline, thioproline, N-alkyl alanine, or absent
  MOD_RES (38)..(38): proline, homoproline, thioproline, N-alkylalanine, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
  MOD_RES (39)..(40): Xaa 39 and Xaa 40 are linked by Lj, Lj is a linking group or spacer group
  MOD_RES (40)..(40): methionine, cysteine, general formula 1, general formula 2 or absent
  MOD_RES (106)..(106): cysteine or serine
  MOD_RES (109)..(109): cysteine or serine
  MOD_RES (124)..(124): cysteine or asparagine
  MOD_RES (156)..(156): cysteine or serine
  MOD_RES (162)..(162): cysteine or serine
XXXGTXTSDXSXXXEXXAXXXFXXXLXXXXXXXXXXXXXXRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDE

SEQ ID NO: 236 - protein, 192 aa, Artificial Sequence
  Description of Artificial Sequence: Synthetic fusion protein
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine, alpha-methyl-histidine, 2-pyridinyl
  MOD_RES (1)..(1): -alanine, 3-pyridinyl-alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid, aminocyclohexanecarboxylic acid, aminocycloheptane-
  MOD_RES (2)..(2): carboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(31): -NH2, glycine, proline, homoproline, thioproline, N-alkyl alanine, or absent
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (34)..(34): glycine, absent, general formula 1, or general formula 2
  MOD_RES (35)..(35): alanine, lysine, cysteine, general formula 1, general formula 2, or absent
  MOD_RES (36)..(36): proline, homoproline, thioproline, N-alkyl alanine, or absent
  MOD_RES (37)..(37): proline, homoproline, thioproline, N-alkyl alanine, or absent
  MOD_RES (38)..(38): proline, homoproline, thioproline, N-alkylalanine, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
  MOD_RES (39)..(40): Xaa 39 and Xaa 40 is linked by Lj, Lj is a linking group or spacer group
  MOD_RES (40)..(40): methionine, cysteine, general formula 1, general formula 2 or absent
  MOD_RES (106)..(106): cysteine or serine
  MOD_RES (109)..(109): cysteine or serine
  MOD_RES (124)..(124): cysteine or asparagine
  MOD_RES (156)..(156): cysteine or serine
  MOD_RES (162)..(162): cysteine or serine
XXEGTFTSDXSXQXEEEAVXLFIEWLXXXXXXXXXXXXXXRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDE

SEQ ID NO: 237 - protein, 192 aa, Artificial Sequence
  Description of Artificial Sequence: Synthetic fusion protein
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): lysine, cysteine, asparagine, leucine, valine, arginine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa 39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
  MOD_RES (39)..(40): Xaa 39 and Xaa 40 is linked by Lj, Lj is a linking group or spacer group
  MOD_RES (40)..(40): methionine, cysteine, general formula 1, general formula 2 or absent
  MOD_RES (124)..(124): cysteine or asparagine
  MOD_RES (156)..(156): cysteine or serine
HXEGTFTSDXSXQXEEEAVXLFIEWLXXXXPXXGXPPPXXRPSGRKSSKMQAFRIWDVNQKTFYLRNNQLVAGYLQGPNVNLEEKIDVVPIEPHALFLGIHGGKMCLSCVKSGDETRLQLEAVXITDLSENRKQDKRFAFIRSDSGPTTSFESAAXPGWFLCTAMEADQPVSLTNMPDEGVMVTKFYFQEDE

SEQ ID NO: 238 - protein, 253 aa, Artificial Sequence
  Description of Artificial Sequence: Synthetic fusion protein
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa 39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
  MOD_RES (40)..(69): "GGGGS" is repeated for 0, 1, 2, 3, 4, 5 or 6 times
  MOD_RES (70)..(70): cysteine, lysine, absent, general formula 1, or general formula 2
  MOD_RES (71)..(100): "GGGGS" is repeated for 0, 1, 2, 3, 4, 5 or 6 times
  MOD_RES (101)..(101): methionine, cysteine, general formula 1, general formula 2 or absent
  MOD_RES (185)..(185): cysteine or asparagine
  MOD_RES (217)..(217): cysteine or serine
HXEGTFTSDXSXQXEEEAVXLFIEWLXXXXPXXGXPPPXGGGGSGGGGSGGGGSGGGGSGGGGSGGGGSXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVXITDLSENRKQDKRFAFIRSDSGPTTSFESAAXPGWFLCTAMEADQPVSLTNMPDEGVMVTKFYFQEDE

SEQ ID NO: 239 - protein, 253 aa, Artificial Sequence
  Description of Artificial Sequence: Synthetic fusion protein
  MOD_RES (12)..(12): lysine, cysteine, arginine, serine, isoleucine, or general formula 1, or general formula 2
  MOD_RES (27)..(27): lysine, cysteine, asparagine, leucine, valine, arginine, general formula 1, or general formula 2
  MOD_RES (40)..(69): "GGGGS" is repeated for 0, 1, 2, 3, 4, 5 or 6 times
  MOD_RES (70)..(70): cysteine, lysine, absent, general formula 1, or general formula 2
  MOD_RES (71)..(100): "GGGGS" is repeated for 0, 1, 2, 3, 4, 5 or 6 times
  MOD_RES (101)..(101): methionine, cysteine, general formula 1, general formula 2 or absent
  MOD_RES (217)..(217): cysteine or serine
HGEGTFTSDLSXQMEEEAVRLFIEWLXNGGPSSGAPPPSGGGGSGGGGSGGGGSGGGGSGGGGSGGGGSXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXPGWFLCTAMEADQPVSLTNMPDEGVMVTKFYFQEDE

SEQ ID NO: 240 - protein, 222 aa, Artificial Sequence
  Description of Artificial Sequence: Synthetic fusion protein
  MOD_RES (12)..(12): lysine, cysteine, arginine, serine, isoleucine, or general formula 1, or general formula 2
  MOD_RES (27)..(27): lysine, cysteine, asparagine, leucine, valine, arginine, general formula 1, or general formula 2
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
  MOD_RES (40)..(69): "GGGGS" is repeated for 0, 1, 2, 3, 4, 5 or 6 times
  MOD_RES (70)..(70): methionine, cysteine, general formula 1, general formula 2 or absent
  MOD_RES (186)..(186): cysteine or serine
HGEGTFTSDLSXQMEEEAVRLFIEWLXNGGPSSGAPPPXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXPGWFLCTAMEADQPVSLTNMPDEGVMVTKFYFQEDE

SEQ ID NO: 241 - protein, 222 aa, Artificial Sequence
  Description of Artificial Sequence: Synthetic fusion protein
  MOD_RES (40)..(69): "GGGGS" is repeated for 0, 1, 2, 3, 4, 5 or 6 times
  MOD_RES (70)..(70): methionine, cysteine, general formula 1, general formula 2 or absent
  MOD_RES (186)..(186): S-OL, S is the sulphur atom on the side chain of a cysteine residue
HGEGTFTSDLSKQMEEEAVRLFIEWLKNGGPSSGAPPPSGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 242 - protein, 222 aa, Artificial Sequence
  Description of Artificial Sequence: Synthetic fusion protein
  MOD_RES (40)..(69): "GGGGS" is repeated for 0, 1, 2, 3, 4, 5 or 6 times
  MOD_RES (70)..(70): methionine, cysteine, general formula 1, general formula 2 or absent
  MOD_RES (154)..(154): S-OL, S is the sulphur atom on the side chain of a cysteine residue
HGEGTFTSDLSKQMEEEAVRLFIEWLKNGGPSSGAPPPSGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 243 - protein, 184 aa, Artificial Sequence
  Description of Artificial Sequence: Synthetic fusion protein
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine, alpha-methyl-histidine, 2-pyridinyl
  MOD_RES (1)..(1): -alanine, 3-pyridinyl-alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (3)..(3): glutamic acid, aspartic acid, or glutamine
  MOD_RES (5)..(5): threonine, aspartic acid, glutamic acid, arginine, alanine, lysine, or histidine
  MOD_RES (6)..(6): phenylalanine, tyrosine, tryptophan, or histidine
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (17)..(17): glutamine, arginine, isoleucine, glutamic acid, aspartic acid, histidine, lysine, cysteine, general formula 1, or general formula 2
  MOD_RES (18)..(18): alanine, arginine, histidine, glutamic acid, or lysine
  MOD_RES (20)..(20): lysine, arginine, aspartic acid, glutamic acid, glutamine, histidine, 2-methylalanine, cysteine, general formula 1, or general formula 2
  MOD_RES (21)..(21): aspartic acid, glutamic acid, leucine, alanine, lysine, cysteine, general formula 1, or general formula 2
  MOD_RES (24)..(24): alanine, glutamine, asparagine, glutamic acid, aspartic acid, serine, or histidine
  MOD_RES (25)..(25): alanine, tryptophan, phenylalanine, tyrosine, cysteine, lysine, general formula 1, or general formula 2
  MOD_RES (27)..(27): valine, leucine, lysine, arginine, alanine, glycine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or spacer
  MOD_RES (31)..(31): group +XG32, in which
  MOD_RES (31)..(32): Xaa 31 and Xaa 32 are linked by Lj, Lj is a linking group or spacer group
  MOD_RES (32)..(32): methionine, cysteine, general formula 1, general formula 2 or absent
  MOD_RES (98)..(98): cysteine or serine
  MOD_RES (101)..(101): cysteine or serine
  MOD_RES (116)..(116): cysteine or asparagine
  MOD_RES (148)..(148): cysteine or serine
  MOD_RES (154)..(154): cysteine or serine
XXXGXXTSDXSXYLEXXXAXXFIXXLXXXXXXRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDE

SEQ ID NO: 244 - protein, 184 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): -spacer group +XG32, in which XG32 is a lysine, cysteine, general formula 3, general formula 4 or absent
  MOD_RES (31)..(32): Xaa 31 and Xaa 32 are linked by Lj, Lj is a linking group or spacer group
  MOD_RES (32)..(32): methionine, cysteine, general formula 1, general formula 2 or absent
  MOD_RES (116)..(116): cysteine or asparagine
  MOD_RES (148)..(148): cysteine or serine
HXEGTFTSDXSXYLEXQAAXEFIAWLVXGRXXRPSGRKSSKMQAFRIWDVNQKTFYLRNNQLVAGYLQGPNVNLEEKIDVVPIEPHALFLGIHGGKMCLSCVKSGDETRLQLEAVXITDLSENRKQDKRFAFIRSDSGPTTSFESAAXPGWFLCTAMEADQPVSLTNMPDEGVMVTKFYFQEDE

SEQ ID NO: 245 - protein, 245 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
  MOD_RES (32)..(61): "GGGGS" is repeated for 0, 1, 2, 3, 4, 5 or 6 times
  MOD_RES (62)..(62): cysteine, lysine, absent, general formula 1, or general formula 2
  MOD_RES (63)..(92): "GGGGS" is repeated for 0, 1, 2, 3, 4, 5 or 6 times
  MOD_RES (93)..(93): Xaa can be any naturally occurring amino acid
  MOD_RES (177)..(177): cysteine or asparagine
  MOD_RES (209)..(209): cysteine or serine
HXEGTFTSDXSXYLEXQAAXEFIAWLVXGRXGGGGSGGGGSGGGGSGGGGSGGGGSGGGGSXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVXITDLSENRKQDKRFAFIRSDSGPTTSFESAAXPGWFLCTAMEADQPVSLTNMPDEGVMVTKFYFQEDE

SEQ ID NO: 246 - protein, 245 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexanecarboxylic
  MOD_RES (2)..(2): acid, aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (32)..(61): "GGGGS" is repeated for 0, 1, 2, 3, 4, 5 or 6 times
  MOD_RES (62)..(62): cysteine, lysine, absent, general formula 1, or general formula 2
  MOD_RES (63)..(92): "GGGGS" is repeated for 0, 1, 2, 3, 4, 5 or 6 times
  MOD_RES (93)..(93): methionine, cysteine, general formula 1, general formula 2 or absent
  MOD_RES (209)..(209): cysteine or serine
HXEGTFTSDXSSYLEXQAAXEFIAWLVXGRGGGGGSGGGGSGGGGSGGGGSGGGGSGGGGSXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXPGWFLCTAMEADQPVSLTNMPDEGVMVTKFYFQEDE

SEQ ID NO: 247 - protein, 214 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
  MOD_RES (32)..(61): "GGGGS" is repeated for 0, 1, 2, 3, 4, 5 or 6 times
  MOD_RES (62)..(62): methionine, cysteine, general formula 1, general formula 2 or absent
  MOD_RES (178)..(178): cysteine or serine
HXEGTFTSDXSSYLEXQAAXEFIAWLVXGRXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXPGWFLCTAMEADQPVSLTNMPDEGVMVTKFYFQEDE

SEQ ID NO: 248 - protein, 214 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (32)..(61): "GGGGS" is repeated for 0, 1, 2, 3, 4, 5 or 6 times
  MOD_RES (62)..(62): methionine, cysteine, general formula 1, general formula 2 or absent
  MOD_RES (178)..(178): S-OL, S is the sulphur atom on the side chain of a cysteine residue
HXEGTFTSDVSSYLEXQAAKEFIAWLVKGRGGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 249 - protein, 214 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (32)..(61): "GGGGS" is repeated for 0, 1, 2, 3, 4, 5 or 6 times
  MOD_RES (62)..(62): methionine, cysteine, general formula 1, general formula 2 or absent
  MOD_RES (146)..(146): S-OL, S is the sulphur atom on the side chain of a cysteine residue
HXEGTFTSDVSSYLEXQAAKEFIAWLVKGRGGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 250 - protein, 254 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1,or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (40)..(69): "GGGGS" is repeated for 0, 1, 2, 3, 4, 5 or 6 times
  MOD_RES (70)..(70): cysteine, lysine, absent, general formula 1, or general formula 2
  MOD_RES (71)..(100): "GGGGS" is repeated for 0, 1, 2, 3, 4, 5 or 6 times
  MOD_RES (101)..(101): methionine, cysteine, general formula 1, general formula 2 or absent
  MOD_RES (217)..(217): cysteine or serine
HXEGTFTSDXSSYLEXQAAXEFIAWLVXGRPSSGAPPPSGGGGSGGGGSGGGGSGGGGSGGGGSGGGGSXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXCPGWFLCTAMEADQPVSLTNMPDEGVMVTKFYFQEDE

SEQ ID NO: 251 - protein, 222 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (39)..(39): Xaa can be any naturally occurring amino acid
  MOD_RES (40)..(69): "GGGGS" is repeated for 0, 1, 2, 3, 4, 5 or 6 times
  MOD_RES (70)..(70): methionine, cysteine, general formula 1, general formula 2 or absent
  MOD_RES (186)..(186): cysteine or serine
HXEGTFTSDXSSYLEXQAAXEFIAWLVXGRPSSGAPPPXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXPGWFLCTAMEADQPVSLTNMPDEGVMVTKFYFQEDE

SEQ ID NO: 252 - protein, 222 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (40)..(69): "GGGGS" is repeated for 0, 1, 2, 3, 4, 5 or 6 times
  MOD_RES (70)..(70): methionine, cysteine, general formula 1, general formula 2 or absent
  MOD_RES (186)..(186): S-OL, S is the sulphur atom on the side chain of a cysteine residue
HXEGTFTSDVSSYLEXQAAKEFIAWLVKGRPSSGAPPPSGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 253 - protein, 222 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (40)..(69): "GGGGS" is repeated for 0, 1, 2, 3, 4, 5 or 6 times
  MOD_RES (70)..(70): methionine, cysteine, general formula 1, general formula 2 or absent
  MOD_RES (154)..(154): S-OL, S is the sulphur atom on the side chain of a cysteine residue
HXEGTFTSDVSSYLEXQAAKEFIAWLVKGRPSSGAPPPSGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 254 - protein, 837 aa, Artificial Sequence
  Description of Artificial Sequence: Synthetic fusion protein
  MOD_RES (40)..(69): "GGGGS" is repeated for 0, 1, 2, 3, 4, 5 or 6 times
  MOD_RES (655)..(684): "GGGGS" is repeated for 0, 1, 2, 3, 4, 5 or 6 times
  MOD_RES (685)..(685): methionine, cysteine, general formula 1, general formula 2 or absent
HGEGTFTSDLSKQMEEEAVRLFIEWLKNGGPSSGAPPPSGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 255 - protein, 837 aa, Artificial Sequence
  Description of Artificial Sequence: Synthetic fusion protein
  MOD_RES (40)..(69): "GGGGS" is repeated for 0, 1, 2, 3, 4, 5 or 6 times
  MOD_RES (70)..(70): methionine, cysteine, general formula 1, general formula 2 or absent
  MOD_RES (223)..(252): "GGGGS" is repeated for 0, 1, 2, 3, 4, 5 or 6 times
HGEGTFTSDLSKQMEEEAVRLFIEWLKNGGPSSGAPPPSGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 256 - protein, 829 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (32)..(61): "GGGGS" is repeated for 0, 1, 2, 3, 4, 5 or 6 times
  MOD_RES (647)..(676): "GGGGS" is repeated for 0, 1, 2, 3, 4, 5 or 6 times
  MOD_RES (677)..(677): methionine, cysteine, general formula 1, general formula 2 or absent
HXEGTFTSDVSSYLEXQAAKEFIAWLVKGRGGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 257 - protein, 829 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (32)..(61): "GGGGS" is repeated for 0, 1, 2, 3, 4, 5 or 6 times
  MOD_RES (62)..(62): methionine, cysteine, general formula 1, general formula 2 or absent
  MOD_RES (215)..(244): "GGGGS" is repeated for 0, 1, 2, 3, 4, 5 or 6 times
HXEGTFTSDVSSYLEXQAAKEFIAWLVKGRGGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 258 - protein, 857 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (32)..(32): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (32)..(32): carboxylic
  MOD_RES (46)..(46): glycine, serine, histidine, glutamic acid, aspartic acid, glutamine, asparagine, lysine, arginine, homoglutamic acid, cysteine, homocysteine, or cysteic acid
  MOD_RES (61)..(90): "GGGGS" is repeated for 0, 1, 2, 3, 4, 5 or 6 times
  MOD_RES (243)..(272): "GGGGS" is repeated for 0, 1, 2, 3, 4, 5 or 6 times
HXEGTFTSDVSSYLEXQAAKEFIAWLVKGRHXEGTFTSDVSSYLEXQAAKEFIAWLVKGRGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 259 - protein, 857 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (32)..(32): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (32)..(32): carboxylic
  MOD_RES (46)..(46): glycine, serine, histidine, glutamic acid, aspartic acid, glutamine, asparagine, lysine, arginine, homoglutamic acid, cysteine, homocysteine, or cysteic acid
  MOD_RES (61)..(90): "GGGGS" is repeated for 0, 1, 2, 3, 4, 5 or 6 times
  MOD_RES (676)..(705): "GGGGS" is repeated for 0, 1, 2, 3, 4, 5 or 6 times
HXEGTFTSDVSSYLEXQAAKEFIAWLVKGRHXEGTFTSDVSSYLEXQAAKEFIAWLVKGRGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 260 - protein, 875 aa, Artificial Sequence
  Description of Artificial Sequence: Synthetic fusion protein
  MOD_RES (31)..(39): P31 to S39 are repeated for 0 or 1 time
  MOD_RES (70)..(78): P70 to S78 are repeated for 0 or 1 time
  MOD_RES (79)..(108): "GGGGS" is repeated for 0, 1, 2, 3, 4, 5 or 6 times
  MOD_RES (261)..(290): "GGGGS" is repeated for 0, 1, 2, 3, 4, 5 or 6 times
HGEGTFTSDLSKQMEEEAVRLFIEWLKNGGPSSGAPPPSHGEGTFTSDLSKQMEEEAVRLFIEWLKNGGPSSGAPPPSGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 261 - protein, 875 aa, Artificial Sequence
  Description of Artificial Sequence: Synthetic fusion protein
  MOD_RES (31)..(39): P31 to S39 are repeated for 0 or 1 time
  MOD_RES (70)..(78): P70 to S78 are repeated for 0 or 1 time
  MOD_RES (79)..(108): "GGGGS" is repeated for 0, 1, 2, 3, 4, 5 or 6 times
  MOD_RES (694)..(723): 694 to S698 are repeated for 0, 1, 2, 3, 4, 5 or 6 times
HGEGTFTSDLSKQMEEEAVRLFIEWLKNGGPSSGAPPPSHGEGTFTSDLSKQMEEEAVRLFIEWLKNGGPSSGAPPPSGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 262 - protein, 485 aa, Artificial Sequence
  Description of Artificial Sequence: Synthetic fusion protein
  MOD_RES (40)..(69): "GGGGS" is repeated for 0, 1, 2, 3, 4, 5 or 6 times
  MOD_RES (70)..(70): methionine, cysteine, general formula 1, general formula 2 or absent
  MOD_RES (223)..(252): "GGGGS" is repeated for 0, 1, 2, 3, 4, 5 or 6 times
HGEGTFTSDLSKQMEEEAVRLFIEWLKNGGPSSGAPPPSGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSGGGGSGGGGSGGGGSGGGGSAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 263 - protein, 485 aa, Artificial Sequence
  Description of Artificial Sequence: Synthetic fusion protein
  MOD_RES (40)..(69): "GGGGS" is repeated for 0, 1, 2, 3, 4, 5 or 6 times
  MOD_RES (303)..(332): "GGGGS" is repeated for 0, 1, 2, 3, 4, 5 or 6 times
  MOD_RES (333)..(333): methionine, cysteine, general formula 1, general formula 2 or absent
HGEGTFTSDLSKQMEEEAVRLFIEWLKNGGPSSGAPPPSGGGGSGGGGSGGGGSGGGGSGGGGSGGGGSAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 264 - protein, 477 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (32)..(61): "GGGGS" is repeated for 0, 1, 2, 3, 4, 5 or 6 times
  MOD_RES (62)..(62): methionine, cysteine, general formula 1, general formula 2 or absent
  MOD_RES (215)..(244): "GGGGS" is repeated for 0, 1, 2, 3, 4, 5 or 6 times
HXEGTFTSDVSSYLEXQAAKEFIAWLVKGRGGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSGGGGSGGGGSGGGGSGGGGSAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 265 - protein, 477 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic acid, aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (32)..(61): "GGGGS" is repeated for 0, 1, 2, 3, 4, 5 or 6 times
  MOD_RES (295)..(324): "GGGGS" is repeated for 0, 1, 2, 3, 4, 5 or 6 times
  MOD_RES (325)..(325): methionine, cysteine, general formula 1, general formula 2 or absent
HXEGTFTSDVSSYLEXQAAKEFIAWLVKGRGGGGGSGGGGSGGGGSGGGGSGGGGSGGGGSAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 266 - protein, 472 aa, Artificial Sequence
  Description of Artificial Sequence: Synthetic fusion protein
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): or carboxylic acid, aminocycloheptanecarboxylic acid, or aminocyclooctanecarboxylic acid
  MOD_RES (32)..(61): "GGGGS" is repeated for 0, 1, 2, 3, 4, 5 or 6 times
  MOD_RES (177)..(177): cysteine or serine
  MOD_RES (214)..(243): "GGGGS" is repeated for 0, 1, 2, 3, 4, 5 or 6 times
HXEGTFTSDVSSYLEEQAAKEFIAWLVKGGGGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXPGWFLCTAMEADQPVSLTNMPDEGVMVTKFYFQEDEGGGGSGGGGSGGGGSGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 267 - protein, 480 aa, Artificial Sequence
  Description of Artificial Sequence: Synthetic fusion protein
  MOD_RES (31)..(39): P31 to S39 are repeated for 0 or 1 time
  MOD_RES (40)..(69): "GGGGS" is repeated for 0, 1, 2, 3, 4, 5 or 6 times
  MOD_RES (185)..(185): cysteine or serine
  MOD_RES (222)..(251): "GGGGS" is repeated for 0, 1, 2, 3, 4, 5 or 6 times
HGEGTFTSDLSKQMEEEAVRLFIEWLKNGGPSSGAPPPSGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXPGWFLCTAMEADQPVSLTNMPDEGVMVTKFYFQEDEGGGGSGGGGSGGGGSGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 268 - protein, 153 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL
  MOD_RES (117)..(117): linking group-GLP-1 receptor binding polypeptide
XRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 269 - protein, 153 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL
  MOD_RES (85)..(85): linking group-GLP-1 receptor binding polypeptide
XRPSGRKSSKMQAFRIWDVNQKTFYLRNNQLVAGYLQGPNVNLEEKIDVVPIEPHALFLGIHGGKMCLSCVKSGDETRLQLEAVCITDLSENRKQDKRFAFIRSDSGPTTSFESAASPGWFLCTAMEADQPVSLTNMPDEGVMVTKFYFQEDE

SEQ ID NO: 270 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha- acetyl-histidine,alpha-methyl-histidine, 2-pyridinyl-alanine,
  MOD_RES (1)..(1): 3-pyridinyl-alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to C39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
XXEGTFTSDXSXQXEEEAVXLFIEWLXXXXPXXGXPPPC

SEQ ID NO: 271 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha -acetyl-histidine, alpha-methyl-histidine, 2-pyridinyl-alanine,
  MOD_RES (1)..(1): 3-pyridinyl-alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa 39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXXXXPXXGCPPPX

SEQ ID NO: 272 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine, alpha-methyl-histidine, 2-pyridinyl
  MOD_RES (1)..(1): -alanine, 3-pyridinyl-alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXXXXPXCGXPPPX

SEQ ID NO: 273 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine, alpha-methyl-histidine, 2-
  MOD_RES (1)..(1): pyridinyl-alanine, 3-pyridinyl-alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa 39 are repeated for 0 or 1 time
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXXXXPCXGXPPPX

SEQ ID NO: 274 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXXXCPXXGXPPPX

SEQ ID NO: 275 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (30)..(30): -NH2, glycine, tyrosine, arginine, lysine, cysteine, general formula 1, general formula 2, or absent
  MOD_RES (31)..(39): P31 to Xaa 39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXXCXPXXGXPPPX

SEQ ID NO: 276 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXCXXPXXGXPPPX

SEQ ID NO: 277 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLCXXXPXXGXPPPX

SEQ ID NO: 278 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVCLFIEWLXXXXPXXGXPPPX

SEQ ID NO: 279 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQCEEEAVXLFIEWLXXXXPXXGXPPPX

SEQ ID NO: 280 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSCQXEEEAVXLFIEWLXXXXPXXGXPPPX

SEQ ID NO: 281 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDCSXQXEEEAVXLFIEWLXXXXPXXGXPPPX

SEQ ID NO: 282 - protein, 40 aa, Unknown
  Description of Unknown: GLP-1 receptor binding polypeptide
HGEGTFTSDLSKQMEEEAVRLFIEWLKNGGPSSGAPPPSC

SEQ ID NO: 283 - protein, 9 aa, Artificial Sequence
  Description of Artificial Sequence: Synthetic fusion protein
  MOD_RES (1)..(1): GLP-1
  MOD_RES (9)..(9): IgG Fc
PSSGAPPPS

SEQ ID NO: 284 - protein, 39 aa, Unknown
  Description of Unknown: GLP-1 receptor binding polypeptide
HGEGTFTSDLSKQMEEEAVRLFIEWLKNGGPSSGCPPPS

SEQ ID NO: 285 - protein, 39 aa, Unknown
  Description of Unknown: GLP-1 receptor binding polypeptide
HGEGTFTSDLSKQMEEEAVRLFIEWLKNGGPSCGAPPPS

SEQ ID NO: 286 - protein, 39 aa, Unknown
  Description of Unknown: GLP-1 receptor binding polypeptide
HGEGTFTSDLSKQMEEEAVRLFIEWLKNGGPCSGAPPPS

SEQ ID NO: 287 - protein, 39 aa, Unknown
  Description of Unknown: GLP-1 receptor binding polypeptide
HGEGTFTSDLSKQMEEEAVRLFIEWLKNGCPSSGAPPPS

SEQ ID NO: 288 - protein, 39 aa, Unknown
  Description of Unknown: GLP-1 receptor binding polypeptide
HGEGTFTSDLSKQMEEEAVRLFIEWLKNCGPSSGAPPPS

SEQ ID NO: 289 - protein, 39 aa, Unknown
  Description of Unknown: GLP-1 receptor binding polypeptide
HGEGTFTSDLSKQMEEEAVRLFIEWLKCGGPSSGAPPPS

SEQ ID NO: 290 - protein, 13 aa, Unknown
  Description of Unknown: amino acid residues at the N-terminal of Fc
AEPKSCDKTHTCP

SEQ ID NO: 291 - protein, 39 aa, Unknown
  Description of Unknown: GLP-1 receptor binding polypeptide
HGEGTFTSDLSKQMEEEAVRLFIECLKNGGPSSGAPPPS

SEQ ID NO: 292 - protein, 39 aa, Unknown
  Description of Unknown: GLP-1 receptor binding polypeptide
HGEGTFTSDLSKQMEEEAVCLFIEWLKNGGPSSGAPPPS

SEQ ID NO: 293 - protein, 39 aa, Unknown
  Description of Unknown: GLP-1 receptor binding polypeptide
HGEGTFTSDLSKQCEEEAVRLFIEWLKNGGPSSGAPPPS

SEQ ID NO: 294 - protein, 39 aa, Unknown
  Description of Unknown: GLP-1 receptor binding polypeptide
HGEGTFTSDLSCQMEEEAVRLFIEWLKNGGPSSGAPPPS

SEQ ID NO: 295 - protein, 39 aa, Unknown
  Description of Unknown: GLP-1 receptor binding polypeptide
HGEGTFTSDCSKQMEEEAVRLFIEWLKNGGPSSGAPPPS

SEQ ID NO: 296 - protein, 31 aa, Unknown
  Description of Unknown: GLP-1 receptor binding polypeptide
HGEGTFTSDLSKQMEEEAVRLFIEWLKNGGC

SEQ ID NO: 297 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to K39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
XXEGTFTSDXSXQXEEEAVXLFIEWLXXXXPXXGXPPPK

SEQ ID NO: 298 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (39)..(39): Xaa can be any naturally occurring amino acid
XXEGTFTSDXSXQXEEEAVXLFIEWLXXXXPXXGKPPPX

SEQ ID NO: 299 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXXXXPXKGXPPPX

SEQ ID NO: 300 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXXXXPKXGXPPPX

SEQ ID NO: 301 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXXXKPXXGXPPPX

SEQ ID NO: 302 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,alpha-methyl-histidine, 2-pyridinyl-
  MOD_RES (1)..(1): alanine, 3-pyridinyl-alanine,4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXXKXPXXGXPPPX

SEQ ID NO: 303 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLXKXXPXXGXPPPX

SEQ ID NO: 304 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVXLFIEWLKXXXPXXGXPPPX

SEQ ID NO: 305 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (27)..(27): methionine, leucine, norleucine, isoleucine, alanine, valine, or general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQXEEEAVKLFIEWLXXXXPXXGXPPPX

SEQ ID NO: 306 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (12)..(12): lysine, cysteine, arginine, serine, isoleucine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXQKEEEAVXLFIEWLXXXXPXXGXPPPX

SEQ ID NO: 307 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (10)..(10): leucine, isoleucine, tyrosine, valine, alanine, lysine, cysteine, general formula 1, general formula 2, or pentaglycine
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSKQXEEEAVXLFIEWLXXXXPXXGXPPPX

SEQ ID NO: 308 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl, arginine, or tyrosine
  MOD_RES (2)..(2): glycine, alanine, 2-methylalanine, D-serine, serine, threonine, leucine, isoleucine, valine, aminocyclopropanecarboxylic acid, aminocyclobutanecarboxylic acid, aminocyclopentanecarboxylic acid,
  MOD_RES (2)..(2): aminocyclohexanecarboxylic acid, aminocycloheptanecarboxylic acid, or aminocyclooctanecarboxylic acid
  MOD_RES (12)..(12): lysine, cysteine, arginine, serine, isoleucine, or general formula 1, or general formula 2
  MOD_RES (14)..(14): methionine, leucine, norleucine, isoleucine, alanine, valine, or general formula 1, or general formula 2
  MOD_RES (20)..(20): lysine, glutamine, cysteine, arginine, general formula 1, or general formula 2
  MOD_RES (27)..(27): lysine, cysteine, asparagine, leucine, valine, arginine, general formula 1, or general formula 2
  MOD_RES (28)..(28): asparagine, lysine, cysteine, arginine, alanine, general formula 1, or general formula 2
  MOD_RES (29)..(29): -NH2, glycine, glutamine, threonine, lysine, cysteine, or absent
  MOD_RES (30)..(30): -NH2, glycine, tyrosine, arginine, lysine, cysteine, general formula 1, general formula 2, or absent
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDKSXQXEEEAVXLFIEWLXXXXPXXGXPPPX

SEQ ID NO: 309 - protein, 40 aa, Unknown
  Description of Unknown: GLP-1 receptor binding polypeptide
HGEGTFTSDLSRQMEEEAVRLFIEWLRNGGPSSGAPPPSK

SEQ ID NO: 310 - protein, 39 aa, Unknown
  Description of Unknown: GLP-1 receptor binding polypeptide
HGEGTFTSDLSRQMEEEAVRLFIEWLRNGGPSSGAPPPK

SEQ ID NO: 311 - protein, 39 aa, Unknown
  Description of Unknown: GLP-1 receptor binding polypeptide
HGEGTFTSDLSRQMEEEAVRLFIEWLRNGGPSSGKPPPS

SEQ ID NO: 312 - protein, 39 aa, Unknown
  Description of Unknown: GLP-1 receptor binding polypeptide
HGEGTFTSDLSRQMEEEAVRLFIEWLRNGGPSKGAPPPS

SEQ ID NO: 313 - protein, 39 aa, Unknown
  Description of Unknown: GLP-1 receptor binding polypeptide
HGEGTFTSDLSRQMEEEAVRLFIEWLRNGGPKSGAPPPS

SEQ ID NO: 314 - protein, 39 aa, Unknown
  Description of Unknown: GLP-1 receptor binding polypeptide
HGEGTFTSDLSRQMEEEAVRLFIEWLRNGKPSSGAPPPS

SEQ ID NO: 315 - protein, 39 aa, Unknown
  Description of Unknown: GLP-1 receptor binding polypeptide
HGEGTFTSDLSRQMEEEAVRLFIEWLRNKGPSSGAPPPS

SEQ ID NO: 316 - protein, 39 aa, Unknown
  Description of Unknown: GLP-1 receptor binding polypeptide
HGEGTFTSDLSRQMEEEAVRLFIEWLRKGGPSSGAPPPS

SEQ ID NO: 317 - protein, 39 aa, Unknown
  Description of Unknown: GLP-1 receptor binding polypeptide
HGEGTFTSDLSRQMEEEAVRLFIEWLKNGGPSSGAPPPS

SEQ ID NO: 318 - protein, 39 aa, Unknown
  Description of Unknown: GLP-1 receptor binding polypeptide
HGEGTFTSDLSRQMEEEAVRLFIEKLRNGGPSSGAPPPS

SEQ ID NO: 319 - protein, 39 aa, Unknown
  Description of Unknown: GLP-1 receptor binding polypeptide
HGEGTFTSDLSRQMEEEAVKLFIEWLRNGGPSSGAPPPS

SEQ ID NO: 320 - protein, 39 aa, Unknown
  Description of Unknown: GLP-1 receptor binding polypeptide
HGEGTFTSDLSRQKEEEAVRLFIEWLRNGGPSSGAPPPS

SEQ ID NO: 321 - protein, 39 aa, Unknown
  Description of Unknown: GLP-1 receptor binding polypeptide
HGEGTFTSDLSKQMEEEAVRLFIEWLRNGGPSSGAPPPS

SEQ ID NO: 322 - protein, 39 aa, Unknown
  Description of Unknown: GLP-1 receptor binding polypeptide
HGEGTFTSDKSRQMEEEAVRLFIEWLRNGGPSSGAPPPS

SEQ ID NO: 323 - protein, 30 aa, Unknown
  Description of Unknown: GLP-1 receptor binding polypeptide
HGEGTFTSDLSRQMEEEAVRLFIEWLRNGK

SEQ ID NO: 324 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl-alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocyclohexanecarboxylic acid, aminocyclo- heptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(39): P31 to C39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
XXEGTFTSDXSXYLEXQAAXEFIAWLVXXXPXXGXPPPC

SEQ ID NO: 325 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocyclohexanecarboxylic acid, aminocyclo- heptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXYLEXQAAXEFIAWLVXXXPXXGCPPPX

SEQ ID NO: 326 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocyclohexanecarboxylic acid, aminocyclo- heptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXYLEXQAAXEFIAWLVXXXPXCGXPPPX

SEQ ID NO: 327 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocyclohexanecarboxylic acid, aminocyclo- heptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(39): P31 to Xaa39 are repeated for 0 or 1 time
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXYLEXQAAXEFIAWLVXXXPCXGXPPPX

SEQ ID NO: 328 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocyclohexanecarboxylic acid, aminocyclo- heptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
XXEGTFTSDXSXYLEXQAAXEFIAWLVXXXC

SEQ ID NO: 329 - protein, 30 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocyclohexanecarboxylic acid, aminocyclo- heptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
XXEGTFTSDXSXYLEXQAAXEFIAWLVXXC

SEQ ID NO: 330 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32,
XXEGTFTSDXSXYLEXQAAXEFIAWLVXCXX

SEQ ID NO: 331 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDXSXYLEXQAAXEFIAWLVCXXX

SEQ ID NO: 332 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDXSXYLEXQAAXEFIACLVXXXX

SEQ ID NO: 333 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDXSXYLEXQAACEFIAWLVXXXX

SEQ ID NO: 334 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDXSCYLEXQAAXEFIAWLVXXXX

SEQ ID NO: 335 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDCSXYLEXQAAXEFIAWLVXXXX

SEQ ID NO: 336 - protein, 39 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVKGRPSSGAPPPC

SEQ ID NO: 337 - protein, 39 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVKGRPSSGCPPPS

SEQ ID NO: 338 - protein, 39 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVKGRPSCGAPPPS

SEQ ID NO: 339 - protein, 39 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVKGRPCSGAPPPS

SEQ ID NO: 340 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVKGRC

SEQ ID NO: 341 - protein, 30 aa, Artificial Sequence
  Description of Artificial Sequence: Synthetic GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVKGC

SEQ ID NO: 342 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVKCRG

SEQ ID NO: 343 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVCGRG

SEQ ID NO: 344 - protein, 30 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVCGR

SEQ ID NO: 345 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIACLVKGRG

SEQ ID NO: 346 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAACEFIAWLVKGRG

SEQ ID NO: 347 - protein, 30 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAACEFIAWLVKGR

SEQ ID NO: 348 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSCYLEXQAAKEFIAWLVKGRG

SEQ ID NO: 349 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDCSSYLEXQAAKEFIAWLVKGRG

SEQ ID NO: 350 - protein, 30 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDCSSYLEXQAAKEFIAWLVKGR

SEQ ID NO: 351 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl-alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(39): P31 to K39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (35)..(35): alanine, lysine, cysteine, general formula 1, general formula 2, or absent
XXEGTFTSDXSXYLEXQAAXEFIAWLVXXXPXXGXPPPK

SEQ ID NO: 352 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl-alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (33)..(33): serine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXYLEXQAAXEFIAWLVXXXPXXGKPPPX

SEQ ID NO: 353 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl-alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(39): P31 to Xaa39 are repeated for 0 or 1 time
  MOD_RES (32)..(32): serine, lysine, cysteine, deletion, general formula 1, or general formula 2
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXYLEXQAAXEFIAWLVXXXPXKGXPPPX

SEQ ID NO: 354 - protein, 39 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(39): P31 to Xaa39 are repeated for 0 or 1 time
  MOD_RES (33)..(33): serine, lysine, cysteine, general formula 1, general formula 2, or absent
  MOD_RES (35)..(35): alanine, lysine, cysteine, general formula 1, general formula 2, or absent
  MOD_RES (39)..(39): serine, serine-NH2, cysteine, cysteine-NH2, lysine, lysine-NH2, or absent, or is a linking or spacer group + XE40, wherein XE40 is a lysine, cysteine, general formula 3, or general formula 4
XXEGTFTSDXSXYLEXQAAXEFIAWLVXXXPKXGXPPPX

SEQ ID NO: 355 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
XXEGTFTSDXSXYLEXQAAXEFIAWLVXXXK

SEQ ID NO: 356 - protein, 30 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
XXEGTFTSDXSXYLEXQAAXEFIAWLVXXK

SEQ ID NO: 357 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32,
XXEGTFTSDXSXYLEXQAAXEFIAWLVXKXX

SEQ ID NO: 358 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDXSXYLEXQAAXEFIAWLVKXXX

SEQ ID NO: 359 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha- acetyl- histidine, alpha-methyl-histidine, 2-pyridinyl-alanine,
  MOD_RES (1)..(1): 3-pyridinyl-alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDXSXYLEXQAAXEFIAKLVXXXX

SEQ ID NO: 360 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDXSXYLEXQAAKEFIAWLVXXXX

SEQ ID NO: 361 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (10)..(10): valine, tyrosine, phenylalanine, tryptophan, histidine, leucine, isoleucine, serine, threonine, aspartic acid, glutamic acid, alanine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDXSKYLEXQAAXEFIAWLVXXXX

SEQ ID NO: 362 - protein, 31 aa, Unknown
  Description of Unknown: GLP-1 receptor binding polypeptide
  MOD_RES (1)..(1): histidine, D-histidine, deamino-histidine, Beta-hydroxyl-histidine, homohistidine, alpha-fluoromethyl- histidine, alpha-methyl-histidine, N-methyl-histidine, Nalpha-acetyl-histidine,
  MOD_RES (1)..(1): alpha-methyl-histidine, 2-pyridinyl-alanine, 3-pyridinyl- alanine, 4-pyridinyl-alanine, imidazopropionyl
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (12)..(12): serine, isoleucine, lysine, arginine, cysteine, general formula 1, or general formula 2
  MOD_RES (16)..(16): glycine, serine, histidine, glutamic acid, aspartic acid, glutamine, asparagine, lysine, arginine, homoglutamic acid, cysteine, homocysteine, or cysteic acid
  MOD_RES (20)..(20): lysine, arginine, aspartic acid, glutamic acid, glutamine, histidine, 2-methylalanine, cysteine, general formula 1, or general formula 2
  MOD_RES (28)..(28): lysine, arginine, aspartic acid, glutamic acid, alanine, asparagine, cysteine, general formula 1, or general formula 2
  MOD_RES (29)..(29): glycine, glutamine, threonine, serine, lysine, arginine, cysteine, general formula 1, or general formula 2
  MOD_RES (30)..(30): arginine, lysine, glycine, histidine, cysteine, general formula 1, or general formula 2
  MOD_RES (31)..(31): -NH2, glycine, threonine, serine, aspartic acid, glutamic acid, tryptophan, tyrosine, phenylalanine, histidine, arginine, lysine, cysteine, a linking or spacer group, general formula 3, general formula 4 or a linking or
  MOD_RES (31)..(31): spacer group +XG32
XXEGTFTSDKSXYLEXQAAXEFIAWLVXXXX

SEQ ID NO: 363 - protein, 39 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAREFIAWLVRGRPSSGAPPPK

SEQ ID NO: 364 - protein, 39 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAREFIAWLVRGRPSSGKPPPS

SEQ ID NO: 365 - protein, 39 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAREFIAWLVRGRPSKGAPPPS

SEQ ID NO: 366 - protein, 39 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAREFIAWLVRGRPKSGAPPPS

SEQ ID NO: 367 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAREFIAWLVRGRK

SEQ ID NO: 368 - protein, 30 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAREFIAWLVRGK

SEQ ID NO: 369 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAREFIAWLVRKRG

SEQ ID NO: 370 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAREFIAWLVKGRG

SEQ ID NO: 371 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexanecarboxylic
  MOD_RES (2)..(2): aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAREFIAKLVRGRG

SEQ ID NO: 372 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVRGRG

SEQ ID NO: 373 - protein, 30 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSSYLEXQAAKEFIAWLVRGR

SEQ ID NO: 374 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDVSKYLEXQAAREFIAWLVRGRG

SEQ ID NO: 375 - protein, 31 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDKSSYLEXQAAREFIAWLVRGRG

SEQ ID NO: 376 - protein, 30 aa, Unknown
  Description of Unknown: GLP-1 receptor binding polypeptide
  MOD_RES (2)..(2): 2-methylalanine (Aib), glycine, D-serine, serine, threonine, leucine, isoleucine, alanine, valine, aminocyclopropane- carboxylic acid, aminocyclobutanecarboxylic acid, aminocyclopentanecarboxylic acid, aminocyclohexane-
  MOD_RES (2)..(2): carboxylic aminocycloheptanecarboxylic acid, or aminocyclooctanecarboxylic acid
  MOD_RES (16)..(16): glycine, serine, histidine, glutamic acid, aspartic acid, glutamine, asparagine, lysine, arginine, homoglutamic acid, cysteine, homocysteine, or cysteic acid
HXEGTFTSDKSSYLEXQAAREFIAWLVRGR

SEQ ID NO: 377 - protein, 154 aa, Artificial Sequence
  Description of Artificial Sequence: Synthetic fusion protein
  MOD_RES (1)..(1): cysteine or absent
  MOD_RES (1)..(1): GLP-1 receptor binding polypeptide - linking group-
  MOD_RES (2)..(2): methionine, cysteine, general formula 1, general formula 2 or absent
  MOD_RES (68)..(68): cysteine or serine
  MOD_RES (71)..(71): cysteine or serine
  MOD_RES (86)..(86): cysteine or asparagine
  MOD_RES (118)..(118): cysteine or serine
  MOD_RES (124)..(124): cysteine or serine
XXRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDE

SEQ ID NO: 378 - protein, 154 aa, Artificial Sequence
  Description of Artificial Sequence: Synthetic fusion protein
  MOD_RES (1)..(1): cysteine or absent
  MOD_RES (1)..(1): -linking group - GLP-1 receptor binding polypeptide
  MOD_RES (2)..(2): methionine, cysteine, general formula 1, general formula 2 or absent
  MOD_RES (118)..(118): cysteine or serine
XXRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXPGWFLCTAMEADQPVSLTNMPDEGVMVTKFYFQEDE

SEQ ID NO: 379 - protein, 154 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (67)..(67): cysteine or serine
  MOD_RES (70)..(70): cysteine or serine
  MOD_RES (85)..(85): cysteine or asparagine
  MOD_RES (117)..(117): cysteine or serine
  MOD_RES (123)..(123): cysteine or serine
  MOD_RES (154)..(154): cysteine or absent
  MOD_RES (154)..(154): - linking group - GLP-1 receptor binding polypeptide
XRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDEX

SEQ ID NO: 380 - protein, 22 aa, Unknown
  Description of Unknown: A chain of insulin receptor binding polypeptide
  MOD_RES (8)..(8): threonine, histidine, or arginine
  MOD_RES (21)..(21): alanine, glycine, or asparagine
  MOD_RES (22)..(22): lysine, a dipeptide of arginine-lysine, or absent
GIVEQCCXSICSLYQLENYCXX

SEQ ID NO: 381 - protein, 21 aa, Unknown
  Description of Unknown: A chain of insulin receptor binding polypeptide
GIVEQCCTSICSLYQLENYCN

SEQ ID NO: 382 - protein, 27 aa, Unknown
  Description of Unknown: B chain of the insulin receptor binding polypeptide
  MOD_RES (1)..(1): tetrapeptide of phenylalanine-valine-asparagine-glutamine, a tripeptide of valine-asparagine-glutamine, a dipeptide of asparagine-glutamine, glutamine, or absent
  MOD_RES (22)..(22): tyrosine, or phenylalanine
  MOD_RES (23)..(23): -NH2, dA-NH2, tyrosine, or phenylalanine
  MOD_RES (24)..(24): threonine, asparagine, or absent
  MOD_RES (25)..(25): lysine, proline, glutamic acid, aspartic acid, or absent
  MOD_RES (26)..(26): proline, arginine, lysine, glutamic acid, aspartic acid, or absent
  MOD_RES (27)..(27): threonine, threonine-arginine-arginine, or absent
XHLCGSHLVEALYLVCGERGFXXXXXX

SEQ ID NO: 383 - protein, 49 aa, Unknown
  Description of Unknown: single-chain insulin receptor binding polypeptide
  MOD_RES (1)..(1): tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the
  MOD_RES (1)..(1): tetrapeptide, tripeptide, and dipeptide is substituted with a lysine or arginine, or absent
  MOD_RES (7)..(7): histidine, phenylalanine, arginine, or glutamine
  MOD_RES (19)..(19): arginine, alanine, glutamic acid, or aspartic acid
  MOD_RES (22)..(22): phenylalanine, tyrosine, or histidine
  MOD_RES (23)..(23): tyrosine, phenylalanine, or absent
  MOD_RES (24)..(24): threonine, asparagine, or absent
  MOD_RES (25)..(25): proline, lysine, glutamic acid, aspartic acid, or absent
  MOD_RES (26)..(26): lysine, proline, arginine, glutamic acid, aspartic acid or absent
  MOD_RES (27)..(27): threonine, or absent
  MOD_RES (27)..(28): Xaa27 andG28 are linked by CL
  MOD_RES (35)..(35): threonine, histidine, or arginine
  MOD_RES (48)..(48): alanine, glycine, or asparagine
  MOD_RES (49)..(49): lysine, a dipeptide of arginine-lysine, or absent
XHLCGSXLVEALYLVCGEXGFXXXXXXGIVEQCCXSICSLYQLENYCXX

SEQ ID NO: 384 - protein, 12 aa, Unknown
  Description of Unknown: CL
  MOD_RES (2)..(2): lysine, cysteine, serine, or alanine
  MOD_RES (3)..(3): glycine, lysine, or serine
  MOD_RES (4)..(4): lysine or serine
  MOD_RES (5)..(5): lysine or serine
  MOD_RES (6)..(6): lysine, serine, or alanine
  MOD_RES (7)..(7): glycine, lysine, arginine, alanine, proline, or absent
  MOD_RES (8)..(8): glycine, alanine, arginine, lysine, glutamine, proline, or absent
  MOD_RES (9)..(9): arginine, lysine, glycine, alanine, proline, threonine, glutamine, or absent
  MOD_RES (10)..(10): proline, glutamine, lysine, glycine, arginine, or absent
  MOD_RES (11)..(11): glutamine, threonine, lysine, glycine, arginine, or absent
  MOD_RES (12)..(12): threonine, arginine, lysine, or absent
GXXXXXXXXXXX

SEQ ID NO: 385 - protein, 12 aa, Unknown
  Description of Unknown: CL peptide
GAGSSSAAAPQT

SEQ ID NO: 386 - protein, 12 aa, Unknown
  Description of Unknown: CL peptide
GSGSSSAAAPQT

SEQ ID NO: 387 - protein, 11 aa, Unknown
  Description of Unknown: CL peptide
GSGSSSAAPQT

SEQ ID NO: 388 - protein, 10 aa, Unknown
  Description of Unknown: CL peptide
GSGSSSAPQT

SEQ ID NO: 389 - protein, 9 aa, Unknown
  Description of Unknown: CL peptide
GSGSSAPQT

SEQ ID NO: 390 - protein, 51 aa, Unknown
  Description of Unknown: single-chain insulin receptor binding polypeptide
  MOD_RES (26)..(26): tyrosine, phenylalanine, or absent
  MOD_RES (27)..(27): threonine, asparagine, or absent
  MOD_RES (28)..(28): proline, lysine, glutamic acid, aspartic acid, or absent
  MOD_RES (29)..(29): lysine, proline, arginine, glutamic acid, aspartic acid or absent
  MOD_RES (30)..(30): threonine, or absent
  MOD_RES (30)..(31): Xaa30 and G31 are linked by CL
FVNQHLCGSHLVEALYLVCGERGFFXXXXXGIVEQCCTSICSLYQLENYCN

SEQ ID NO: 391 - protein, 22 aa, Unknown
  Description of Unknown: A chain of the insulin receptor binding polypeptide
  MOD_RES (12)..(12): serine or a structure of general formula 1
  MOD_RES (14)..(14): tyrosine or a structure of general formula 1
  MOD_RES (15)..(15): glutamine or a structure of general formula 1
  MOD_RES (17)..(17): glutamic acid or a structure of general formula 1
  MOD_RES (18)..(18): asparagine or a structure of general formula 1
  MOD_RES (21)..(21): asparagine, alanine, or glycine
  MOD_RES (22)..(22): lysine, general formula 3, arginine-general formula 3 or absent
GIVEQCCTSICXLXXLXXYCXX

SEQ ID NO: 392 - protein, 28 aa, Unknown
  Description of Unknown: B chain of the insulin receptor binding polypeptide
  MOD_RES (1)..(1): glycine-proline-glutamic acid tripeptide, UL-glycine-proline-glutamic acid, a tetrapeptide of phenylalanine-valine-asparagine-glutamine or UL-phenylalanine-valine-asparagine-glutamine
  MOD_RES (22)..(22): tyrosine or phenylalanine
  MOD_RES (23)..(23): -NH2, phenylalanine, tyrosine, or absent
  MOD_RES (24)..(24): threonine, asparagine, or absent
  MOD_RES (25)..(25): lysine, arginine, glutamic acid, aspartic acid, proline, or absent
  MOD_RES (26)..(26): proline, lysine, arginine, glutamic acid, aspartic acid, or absent, or is a structure of general formula 1 or 3
  MOD_RES (27)..(27): threonine, lysine, or absent, or is a structure of general formula 1 or 3
  MOD_RES (28)..(28): lysine or absent, or is a structure of general formula 3
XHLCGSHLVEALYLVCGERGFXXXXXXX

SEQ ID NO: 393 - protein, 61 aa, Unknown
  Description of Unknown: single-chain insulin receptor binding polypeptide
  MOD_RES (1)..(1): a tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the
  MOD_RES (1)..(1): tetrapeptide,tripeptide, and dipeptide is substituted with a lysine or arginine, or absent
  MOD_RES (1)..(1): UL-
  MOD_RES (22)..(22): phenylalanine, histidine or tyrosine
  MOD_RES (23)..(23): -NH2, tyrosine, phenylalanine, or absent
  MOD_RES (24)..(24): threonine, asparagine, or absent
  MOD_RES (25)..(25): proline, lysine, glutamic acid, aspartic acid, or absent
  MOD_RES (26)..(26): aspartic acid, glutamic acid, proline, arginine, lysine, absent or a structure of general formula 1
  MOD_RES (27)..(27): threonine, a structure of general formula 1, or absent
  MOD_RES (29)..(29): serine, alanine, glycine, lysine, a structure of general formula 1, or absent
  MOD_RES (30)..(30): glycine, a structure of general formula 1, or absent
  MOD_RES (31)..(31): lysine, glycine, serine, a structure of general formula 1, or absent
  MOD_RES (32)..(32): lysine, glycine, serine, a structure of general formula 1, or absent
  MOD_RES (33)..(33): lysine, glycine, serine, alanine, a structure of general formula 1, or absent
  MOD_RES (34)..(34): lysine, arginine, alanine, proline, glycine, a structure of general formula 1, or absent
  MOD_RES (35)..(35): glycine, alanine, arginine, lysine, glutamine, proline, a structure of general formula 1, or absent
  MOD_RES (36)..(36): arginine, alanine, proline, threonine, glutamine, glycine, a structure of general formula 1, or absent
  MOD_RES (37)..(37): proline, glutamine, arginine, glycine, absent, or a structure of general formula 1
  MOD_RES (38)..(38): glutamine, threonine, arginine, glycine, absent, or a structure of general formula 1
  MOD_RES (39)..(39): threonine, arginine, lysine, or absent
  MOD_RES (47)..(47): threonine, histidine, arginine or a structure of general formula 1
  MOD_RES (51)..(51): serine or a structure of general formula 1
  MOD_RES (53)..(53): tyrosine or a structure of general formula 1
  MOD_RES (54)..(54): glutamine or a structure of general formula 1
  MOD_RES (56)..(56): glutamic acid or a structure of general formula 1
  MOD_RES (57)..(57): asparagine or a structure of general formula 1
  MOD_RES (60)..(60): aspartic acid, glycine, alanine, or a structure of general formula 1
  MOD_RES (61)..(61): lysine, general formula 3, arginine-general formula 3, or absent
XHLCGSHLVEALYLVCGERGFXXXXXXGXXXXXXXXXXXGIVEQCCXSICXLXXLXXYCXX

SEQ ID NO: 394 - protein, 64 aa, Unknown
  Description of Unknown: single-chain insulin receptor binding polypeptide
  MOD_RES (26)..(26): -NH2, tyrosine, phenylalanine, or absent
  MOD_RES (27)..(27): threonine, asparagine, or absent
  MOD_RES (28)..(28): proline, lysine, glutamic acid, aspartic acid, or absent
  MOD_RES (29)..(29): aspartic acid, glutamic acid, proline, arginine, lysine, absent or a structure of general formula 1
  MOD_RES (30)..(30): threonine, a structure of general formula 1, or absent
  MOD_RES (32)..(32): serine, alanine, glycine, lysine, a structure of general formula 1, or absent
  MOD_RES (33)..(33): glycine, a structure of general formula 1, or absent
  MOD_RES (34)..(34): lysine, glycine, serine, a structure of general formula 1, or absent
  MOD_RES (35)..(35): lysine, glycine, serine, a structure of general formula 1, or absent
  MOD_RES (36)..(36): lysine, glycine, serine, alanine, a structure of general formula 1, or absent
  MOD_RES (37)..(37): lysine, arginine, alanine, proline, glycine, a structure of general formula 1, or absent
  MOD_RES (38)..(38): glycine, alanine, arginine, lysine, glutamine, proline, a structure of general formula 1, or absent
  MOD_RES (39)..(39): arginine, alanine, proline, threonine, glutamine, glycine, a structure of general formula 1, or absent
  MOD_RES (40)..(40): proline, glutamine, arginine, glycine, absent, or a structure of general formula 1
  MOD_RES (41)..(41): glutamine, threonine, arginine, glycine, absent, or a structure of general formula 1
  MOD_RES (42)..(42): threonine, arginine, lysine, or absent
  MOD_RES (64)..(64): lysine, general formula 3, arginine-general formula 3, or absent
FVNQHLCGSHLVEALYLVCGERGFFXXXXXGXXXXXXXXXXXGIVEQCCTSICSLYQLENYCNX

SEQ ID NO: 395 - protein, 202 aa, Artificial Sequence
  Description of Artificial Sequence: Synthetic fusion protein
  MOD_RES (1)..(1): a tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the
  MOD_RES (1)..(1): tetrapeptide, tripeptide, and dipeptide is substituted with a lysine or arginine, or absent
  MOD_RES (1)..(1): UL-
  MOD_RES (7)..(7): histidine, phenylalanine, arginine, or glutamine
  MOD_RES (19)..(19): arginine, alanine, glutamic acid, or aspartic acid
  MOD_RES (22)..(22): phenylalanine, tyrosine, or histidine
  MOD_RES (23)..(23): tyrosine, phenylalanine, or absent
  MOD_RES (24)..(24): threonine, asparagine, or absent
  MOD_RES (25)..(25): proline, lysine, glutamic acid, aspartic acid, or absent
  MOD_RES (26)..(26): lysine, proline, arginine, glutamic acid, aspartic acid or absent
  MOD_RES (27)..(27): threonine, or absent
  MOD_RES (27)..(28): Xaa27 and G28 are linked by CL
  MOD_RES (35)..(35): threonine, histidine, or arginine
  MOD_RES (48)..(48): alanine, glycine, or asparagine
  MOD_RES (49)..(49): lysine, a dipeptide of arginine-lysine, or absent
  MOD_RES (49)..(50): Xaa49 and Xaa50 are linked by Lj
  MOD_RES (50)..(50): methionine, cysteine, general formula 1, general formula 2 or absent
  MOD_RES (116)..(116): cysteine or serine
  MOD_RES (119)..(119): cysteine or serine
  MOD_RES (134)..(134): cysteine or asparagine
  MOD_RES (166)..(166): cysteine or serine
  MOD_RES (172)..(172): cysteine or serine
XHLCGSXLVEALYLVCGEXGFXXXXXXGIVEQCCXSICSLYQLENYCXXXRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDE

SEQ ID NO: 396 - protein, 262 aa, Artificial Sequence
  Description of Artificial Sequence: Synthetic fusion protein
  MOD_RES (1)..(1): a tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the
  MOD_RES (1)..(1): tetrapeptide,tripeptide, and dipeptide is substituted with a lysine or arginine, or absent
  MOD_RES (1)..(1): UL-
  MOD_RES (22)..(22): phenylalanine, tyrosine, or histidine
  MOD_RES (23)..(23): tyrosine, phenylalanine, or absent
  MOD_RES (24)..(24): threonine, asparagine, or absent
  MOD_RES (25)..(25): proline, lysine, glutamic acid, aspartic acid, or absent
  MOD_RES (26)..(26): lysine, proline, arginine, glutamic acid, aspartic acid or absent
  MOD_RES (27)..(27): threonine, or absent
  MOD_RES (27)..(28): Xaa27 and G28 are linked by CL
  MOD_RES (49)..(78): "GGGGS" is repeated for 0, 1, 2, 3, 4, 5 or 6 times
  MOD_RES (79)..(79): cysteine, lysine, absent, general formula 1, or general formula 2
  MOD_RES (80)..(109): "GGGGS" is repeated for 0, 1, 2, 3, 4, 5 or 6 times
  MOD_RES (110)..(110): methionine, cysteine, general formula 1, general formula 2 or absent
  MOD_RES (176)..(176): cysteine or serine
  MOD_RES (179)..(179): cysteine or serine
  MOD_RES (194)..(194): cysteine or asparagine
  MOD_RES (226)..(226): cysteine or serine
  MOD_RES (232)..(232): cysteine or serine
XHLCGSHLVEALYLVCGERGFXXXXXXGIVEQCCTSICSLYQLENYCNGGGGSGGGGSGGGGSGGGGSGGGGSGGGGSXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDE

SEQ ID NO: 397 - protein, 265 aa, Artificial Sequence
  Description of Artificial Sequence: Synthetic fusion protein
  MOD_RES (1)..(1): UL-
  MOD_RES (30)..(31): T30 and G31 are linked by CL
  MOD_RES (52)..(81): "GGGGS" is repeated for 0, 1, 2, 3, 4, 5 or 6 times
  MOD_RES (82)..(82): cysteine, lysine, absent, general formula 1, or general formula 2
  MOD_RES (83)..(112): "GGGGS" is repeated for 0, 1, 2, 3, 4, 5 or 6 times
  MOD_RES (113)..(113): methionine, cysteine, general formula 1, general formula 2 or absent
  MOD_RES (179)..(179): cysteine or serine
  MOD_RES (182)..(182): cysteine or serine
  MOD_RES (229)..(229): cysteine or serine
  MOD_RES (235)..(235): cysteine or serine
FVNQHLCGSHLVEALYLVCGERGFFYTPKTGIVEQCCTSICSLYQLENYCNGGGGSGGGGSGGGGSGGGGSGGGGSGGGGSXGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDE

SEQ ID NO: 398 - protein, 234 aa, Artificial Sequence
  Description of Artificial Sequence: Synthetic fusion protein
  MOD_RES (1)..(1): UL-
  MOD_RES (30)..(31): T30 and G31 are linked by CL
  MOD_RES (52)..(81): G52 and S56 are repeated for 0, 1, 2, 3, 4, 5 or 6 times
  MOD_RES (82)..(82): methionine, cysteine, general formula 1, general formula 2 or absent
  MOD_RES (148)..(148): cysteine or serine
  MOD_RES (151)..(151): cysteine or serine
  MOD_RES (198)..(198): cysteine or serine
  MOD_RES (204)..(204): cysteine or serine
FVNQHLCGSHLVEALYLVCGERGFFYTPKTGIVEQCCTSICSLYQLENYCNGGGGSGGGGSGGGGSGGGGSGGGGSGGGGSXRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDE

SEQ ID NO: 399 - protein, 202 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (67)..(67): cysteine or serine
  MOD_RES (70)..(70): cysteine or serine
  MOD_RES (85)..(85): cysteine or asparagine
  MOD_RES (117)..(117): cysteine or serine
  MOD_RES (123)..(123): cysteine or serine
  MOD_RES (153)..(154): E153 and Xaa154 are linked by Lj
  MOD_RES (154)..(154): a tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the
  MOD_RES (154)..(154): tetrapeptide,tripeptide, and dipeptide is substituted with a lysine or arginine, or absent
  MOD_RES (160)..(160): histidine, phenylalanine, arginine, or glutamine
  MOD_RES (172)..(172): arginine, alanine, glutamic acid, or aspartic acid
  MOD_RES (175)..(175): phenylalanine, tyrosine, or histidine
  MOD_RES (176)..(176): tyrosine, phenylalanine, or absent
  MOD_RES (177)..(177): threonine, asparagine, or absent
  MOD_RES (178)..(178): proline, lysine, glutamic acid, aspartic acid, or absent
  MOD_RES (179)..(179): lysine, proline, arginine, glutamic acid, aspartic acid or absent
  MOD_RES (180)..(180): threonine, or absent
  MOD_RES (180)..(181): Xaa180 and G181 are linked by CL
  MOD_RES (188)..(188): threonine, histidine, or arginine
  MOD_RES (201)..(201): alanine, glycine, or asparagine
  MOD_RES (202)..(202): lysine, a dipeptide of arginine-lysine, or absent
XRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDEXHLCGSXLVEALYLVCGEXGFXXXXXXGIVEQCCXSICSLYQLENYCXX

SEQ ID NO: 400 - protein, 263 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (67)..(67): cysteine or serine
  MOD_RES (70)..(70): cysteine or serine
  MOD_RES (85)..(85): cysteine or asparagine
  MOD_RES (117)..(117): cysteine or serine
  MOD_RES (123)..(123): cysteine or serine
  MOD_RES (154)..(183): "GGGGS" is repeated for 0, 1, 2, 3, 4, 5 or 6 times
  MOD_RES (184)..(184): cysteine, lysine, absent, general formula 1, or general formula 2
  MOD_RES (185)..(214): "GGGGS" is repeated for 0, 1, 2, 3, 4, 5 or 6 times
  MOD_RES (215)..(215): a tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the
  MOD_RES (215)..(215): tetrapeptide,tripeptide, and dipeptide is substituted with a lysine or arginine, or absent
  MOD_RES (236)..(236): phenylalanine, tyrosine, or histidine
  MOD_RES (237)..(237): tyrosine, phenylalanine, or absent
  MOD_RES (238)..(238): threonine, asparagine, or absent
  MOD_RES (239)..(239): proline, lysine, glutamic acid, aspartic acid, or absent
  MOD_RES (240)..(240): lysine, proline, arginine, glutamic acid, aspartic acid or absent
  MOD_RES (241)..(241): threonine, or absent
  MOD_RES (241)..(242): Xaa241 and G242 are linked by CL
  MOD_RES (262)..(262): alanine, glycine, or asparagine
  MOD_RES (263)..(263): lysine, a dipeptide of arginine-lysine, or absent
XRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDEGGGGSGGGGSGGGGSGGGGSGGGGSGGGGSXGGGGSGGGGSGGGGSGGGGSGGGGSGGGGSXHLCGSHLVEALYLVCGERGFXXXXXXGIVEQCCTSICSLYQLENYCXX

SEQ ID NO: 401 - protein, 265 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (67)..(67): cysteine or serine
  MOD_RES (70)..(70): cysteine or serine
  MOD_RES (117)..(117): cysteine or serine
  MOD_RES (123)..(123): cysteine or serine
  MOD_RES (154)..(183): "GGGGS" is repeated for 0, 1, 2, 3, 4, 5 or 6 times
  MOD_RES (184)..(184): cysteine, lysine, absent, general formula 1, or general formula 2
  MOD_RES (185)..(214): "GGGGS" is repeated for 0, 1, 2, 3, 4, 5 or 6 times
  MOD_RES (244)..(245): T244 and G245 are linked by CL
XRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDEGGGGSGGGGSGGGGSGGGGSGGGGSGGGGSXGGGGSGGGGSGGGGSGGGGSGGGGSGGGGSFVNQHLCGSHLVEALYLVCGERGFFYTPKTGIVEQCCTSICSLYQLENYCN

SEQ ID NO: 402 - protein, 234 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (67)..(67): cysteine or serine
  MOD_RES (70)..(70): cysteine or serine
  MOD_RES (117)..(117): cysteine or serine
  MOD_RES (123)..(123): cysteine or serine
  MOD_RES (154)..(183): "GGGGS" is repeated for 0, 1, 2, 3, 4, 5 or 6 times
  MOD_RES (213)..(214): T213 and G214 are linked by CL
XRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDEGGGGSGGGGSGGGGSGGGGSGGGGSGGGGSFVNQHLCGSHLVEALYLVCGERGFFYTPKTGIVEQCCTSICSLYQLENYCN

SEQ ID NO: 403 - protein, 277 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (67)..(67): cysteine or serine
  MOD_RES (70)..(70): cysteine or serine
  MOD_RES (85)..(85): cysteine or asparagine
  MOD_RES (117)..(117): cysteine or serine
  MOD_RES (123)..(123): cysteine or serine
  MOD_RES (154)..(183): "GGGGS" is repeated for 0, 1, 2, 3, 4, 5 or 6 times
  MOD_RES (184)..(184): cysteine, lysine, absent, general formula 1, or general formula 2
  MOD_RES (185)..(214): "GGGGS" is repeated for 0, 1, 2, 3, 4, 5 or 6 times
XRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDEGGGGSGGGGSGGGGSGGGGSGGGGSGGGGSXGGGGSGGGGSGGGGSGGGGSGGGGSGGGGSFVNQHLCGSHLVEALYLVCGERGFFYTPKTGSGSSSAAAPQTGIVEQCCTSICSLYQLENYCN

SEQ ID NO: 404 - protein, 848 aa, Artificial Sequence
  Description of Artificial Sequence: Synthetic fusion protein
  MOD_RES (586)..(615): "GGGGS" is repeated for 0, 1, 2, 3, 4, 5 or 6 times
  MOD_RES (645)..(646): T645 and G646 are linked by CL
  MOD_RES (667)..(696): "GGGGS" is repeated for 0, 1, 2, 3, 4, 5 or 6 times
  MOD_RES (762)..(762): cysteine or serine
  MOD_RES (765)..(765): cysteine or serine
  MOD_RES (812)..(812): cysteine or serine
  MOD_RES (818)..(818): cysteine or serine
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSFVNQHLCGSHLVEALYLVCGERGFFYTPKTGIVEQCCTSICSLYQLENYCNGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDE

SEQ ID NO: 405 - protein, 848 aa, Artificial Sequence
  Description of Artificial Sequence: Synthetic fusion protein
  MOD_RES (30)..(31): T30 and G31 are linked by CL
  MOD_RES (52)..(81): "GGGGS" is repeated for 0, 1, 2, 3, 4, 5 or 6 times
  MOD_RES (667)..(696): "GGGGS" is repeated for 0, 1, 2, 3, 4, 5 or 6 times
  MOD_RES (762)..(762): cysteine or serine
  MOD_RES (765)..(765): cysteine or serine
  MOD_RES (812)..(812): cysteine or serine
  MOD_RES (818)..(818): cysteine or serine
FVNQHLCGSHLVEALYLVCGERGFFYTPKTGIVEQCCTSICSLYQLENYCNGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDE

SEQ ID NO: 406 - protein, 848 aa, Artificial Sequence
  Description of Artificial Sequence: Synthetic fusion protein
  MOD_RES (30)..(31): T30 and G31 are linked by CL
  MOD_RES (52)..(81): "GGGGS" is repeated for 0, 1, 2, 3, 4, 5 or 6 times
  MOD_RES (147)..(147): cysteine or serine
  MOD_RES (150)..(150): cysteine or serine
  MOD_RES (197)..(197): cysteine or serine
  MOD_RES (203)..(203): cysteine or serine
  MOD_RES (234)..(263): "GGGGS" is repeated for 0, 1, 2, 3, 4, 5 or 6 times
FVNQHLCGSHLVEALYLVCGERGFFYTPKTGIVEQCCTSICSLYQLENYCNGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDEGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 407 - protein, 820 aa, Artificial Sequence
  Description of Artificial Sequence: Synthetic fusion protein
  MOD_RES (139)..(195): cysteine or serine
FVNQHLCGSHLVEALYLVCGERGFFYTPKTGSGSSSAAAPQTGIVEQCCTSICSLYQLENYCNGGGGSGGGGSRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDEGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 408 - protein, 849 aa, Artificial Sequence
  Description of Artificial Sequence: Synthetic fusion protein
  MOD_RES (1)..(1): methionine, cysteine, general formula 1, general formula 2 or absent
  MOD_RES (67)..(67): cysteine or serine
  MOD_RES (70)..(70): cysteine or serine
  MOD_RES (117)..(117): cysteine or serine
  MOD_RES (123)..(123): cysteine or serine
  MOD_RES (154)..(183): "GGGGS" is repeated for 0, 1, 2, 3, 4, 5 or 6 times
  MOD_RES (769)..(798): "GGGGS" is repeated for 0, 1, 2, 3, 4, 5 or 6 times
  MOD_RES (828)..(829): T828 and G829 are linked by CL
XRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDEGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSFVNQHLCGSHLVEALYLVCGERGFFYTPKTGIVEQCCTSICSLYQLENYCN

SEQ ID NO: 409 - protein, 849 aa, Artificial Sequence
  Description of Artificial Sequence: Synthetic fusion protein
  MOD_RES (1)..(1): methionine, cysteine, general formula 1, general formula 2 or absent
  MOD_RES (67)..(67): cysteine or serine
  MOD_RES (70)..(70): cysteine or serine
  MOD_RES (117)..(117): cysteine or serine
  MOD_RES (123)..(123): cysteine or serine
  MOD_RES (154)..(183): "GGGGS" is repeated for 0, 1, 2, 3, 4, 5 or 6 times
  MOD_RES (213)..(214): T214 and G213 are linked by CL
  MOD_RES (235)..(264): "GGGGS" is repeated for 0, 1, 2, 3, 4, 5 or 6 times
XRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDEGGGGSGGGGSGGGGSGGGGSGGGGSGGGGSFVNQHLCGSHLVEALYLVCGERGFFYTPKTGIVEQCCTSICSLYQLENYCNGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 410 - protein, 153 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (67)..(123): cysteine or serine
  MOD_RES (117)..(117): linking group-insulin receptor binding polypeptide
XRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAACPGWFLXTAMEADQPVSLTNMPDEGVMVTKFYFQEDE

SEQ ID NO: 411 - protein, 153 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (67)..(123): cysteine or serine
  MOD_RES (85)..(85): linking group-insulin receptor binding polypeptide
XRPSGRKSSKMQAFRIWDVNQKTFYLRNNQLVAGYLQGPNVNLEEKIDVVPIEPHALFLGIHGGKMXLSXVKSGDETRLQLEAVCITDLSENRKQDKRFAFIRSDSGPTTSFESAASPGWFLXTAMEADQPVSLTNMPDEGVMVTKFYFQEDE

SEQ ID NO: 412 - protein, 154 aa, Artificial Sequence; identical to SEQ ID NO: 377
  Description of Artificial Sequence: Synthetic fusion protein
  MOD_RES (1)..(1): cysteine or absent
  MOD_RES (1)..(1): insulin receptor binding polypeptide - linking group
  MOD_RES (2)..(2): methionine, cysteine, general formula 1, general formula 2 or absent
  MOD_RES (68)..(71): cysteine or serine
  MOD_RES (86)..(86): cysteine or asparagine
  MOD_RES (118)..(124): cysteine or serine

SEQ ID NO: 413 - protein, 154 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (67)..(70): cysteine or serine
  MOD_RES (85)..(85): cysteine or asparagine
  MOD_RES (117)..(123): cysteine or serine
  MOD_RES (154)..(154): linking group-insulin receptor binding polypeptide
XRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDEC

SEQ ID NO: 414 - protein, 49 aa, Unknown; identical to SEQ ID NO: 383
  Description of Unknown: single-chain insulin receptor binding polypeptide
  MOD_RES (1)..(1): a tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the
  MOD_RES (1)..(1): tetrapeptide,tripeptide, and dipeptide is substituted with a lysine or arginine, or absent
  MOD_RES (1)..(1): UL-
  MOD_RES (7)..(7): histidine, phenylalanine, arginine, or glutamine
  MOD_RES (19)..(19): arginine, alanine, glutamic acid, or aspartic acid
  MOD_RES (22)..(22): phenylalanine, tyrosine, or histidine
  MOD_RES (23)..(23): tyrosine, phenylalanine, or absent
  MOD_RES (24)..(24): threonine, asparagine, or absent
  MOD_RES (25)..(25): proline, lysine, glutamic acid, aspartic acid, or absent
  MOD_RES (26)..(26): lysine, proline, arginine, glutamic acid, aspartic acid or absent
  MOD_RES (27)..(27): threonine, or absent
  MOD_RES (27)..(28): Xaa27 and G28 are linked by CL
  MOD_RES (35)..(35): threonine, histidine, or arginine
  MOD_RES (48)..(48): alanine, glycine, or asparagine
  MOD_RES (49)..(49): lysine, a dipeptide of arginine-lysine, or absent

SEQ ID NO: 415 - protein, 49 aa, Unknown
  Description of Unknown: single-chain insulin receptor binding polypeptide
  MOD_RES (1)..(1): a tetrapeptide of phenylalanine-valine-asparagine-glutamine, a tripeptide of valine-asparagine-glutamine, a dipeptide of asparagine-glutamine, glutamine, a sequence wherein any one of the amino acid residues in the sequence of the
  MOD_RES (1)..(1): tetrapeptide,tripeptide, and dipeptide is substituted with a lysine or arginine, or absent
  MOD_RES (1)..(1): UL-
  MOD_RES (22)..(22): phenylalanine, tyrosine, or histidine
  MOD_RES (23)..(23): tyrosine, phenylalanine, or absent
  MOD_RES (24)..(24): threonine, asparagine, or absent
  MOD_RES (25)..(25): proline, lysine, glutamic acid, aspartic acid, or absent
  MOD_RES (26)..(26): lysine, proline, arginine, glutamic acid, aspartic acid or absent
  MOD_RES (27)..(27): threonine, or absent
  MOD_RES (27)..(28): Xaa27  and G28 are linked by CL
  MOD_RES (48)..(48): alanine, glycine, or asparagine
  MOD_RES (49)..(49): lysine, a dipeptide of arginine-lysine, or absent
XHLCGSHLVEALYLVCGERGFXXXXXXGIVEQCCTSICSLYQLENYCXX

SEQ ID NO: 416 - protein, 51 aa, Unknown
  Description of Unknown: single-chain insulin receptor binding polypeptide
  MOD_RES (1)..(1): UL-
  MOD_RES (29)..(29): lysine, proline, arginine, glutamic acid, aspartic acid or absent
  MOD_RES (30)..(31): T30 and G31 are linked by CL
FVNQHLCGSHLVEALYLVCGERGFFYTPXTGIVEQCCTSICSLYQLENYCN

SEQ ID NO: 417 - protein, 63 aa, Unknown
  Description of Unknown: single-chain insulin receptor binding polypeptide
  MOD_RES (1)..(1): UL-
  MOD_RES (29)..(29): lysine, proline, arginine, glutamic acid, aspartic acid or absent
FVNQHLCGSHLVEALYLVCGERGFFYTPXTGKGSSSAAAPQTGIVEQCCTSICSLYQLENYCN

SEQ ID NO: 418 - protein, 63 aa, Unknown
  Description of Unknown: single-chain insulin receptor binding polypeptide
  MOD_RES (1)..(1): UL-
  MOD_RES (29)..(29): lysine, proline, arginine, glutamic acid, aspartic acid or absent
FVNQHLCGSHLVEALYLVCGERGFFYTPXTGSGKSSAAAPQTGIVEQCCTSICSLYQLENYCN

SEQ ID NO: 419 - protein, 63 aa, Unknown
  Description of Unknown: single-chain insulin receptor binding polypeptide
  MOD_RES (1)..(1): UL-
  MOD_RES (29)..(29): lysine, proline, arginine, glutamic acid, aspartic acid or absent
FVNQHLCGSHLVEALYLVCGERGFFYTPXTGSGSKSAAAPQTGIVEQCCTSICSLYQLENYCN

SEQ ID NO: 420 - protein, 63 aa, Unknown
  Description of Unknown: single-chain insulin receptor binding polypeptide
  MOD_RES (1)..(1): UL-
  MOD_RES (29)..(29): lysine, proline, arginine, glutamic acid, aspartic acid or absent
FVNQHLCGSHLVEALYLVCGERGFFYTPXTGSGSSKAAAPQTGIVEQCCTSICSLYQLENYCN

SEQ ID NO: 421 - protein, 63 aa, Unknown
  Description of Unknown: single-chain insulin receptor binding polypeptide
  MOD_RES (1)..(1): UL-
  MOD_RES (29)..(29): lysine, proline, arginine, glutamic acid, aspartic acid or absent
FVNQHLCGSHLVEALYLVCGERGFFYTPXTGSGSSSKAAPQTGIVEQCCTSICSLYQLENYCN

SEQ ID NO: 422 - protein, 63 aa, Unknown
  Description of Unknown: single-chain insulin receptor binding polypeptide
  MOD_RES (1)..(1): UL-
  MOD_RES (29)..(29): lysine, proline, arginine, glutamic acid, aspartic acid or absent
FVNQHLCGSHLVEALYLVCGERGFFYTPXTGSGSSSAKAPQTGIVEQCCTSICSLYQLENYCN

SEQ ID NO: 423 - protein, 63 aa, Unknown
  Description of Unknown: single-chain insulin receptor binding polypeptide
  MOD_RES (1)..(1): UL-
  MOD_RES (29)..(29): lysine, proline, arginine, glutamic acid, aspartic acid or absent
FVNQHLCGSHLVEALYLVCGERGFFYTPXTGSGSSSAAKPQTGIVEQCCTSICSLYQLENYCN

SEQ ID NO: 424 - protein, 64 aa, Unknown
  Description of Unknown: single-chain insulin receptor binding polypeptide
  MOD_RES (1)..(1): UL-
  MOD_RES (29)..(29): lysine, proline, arginine, glutamic acid, aspartic acid or absent
FVNQHLCGSHLVEALYLVCGERGFFYTPXTGSGSSSAAAPQTGIVEQCCTSICSLYQLENYCNK

SEQ ID NO: 425 - protein, 63 aa, Unknown
  Description of Unknown: single-chain insulin receptor binding polypeptide
  MOD_RES (29)..(29): lysine, proline, arginine, glutamic acid, aspartic acid or absent
FVNQHLCGSHLVEALYLVCGERGFFYTPXTGSGSSSAAAPQTGIVEQCCTSICSLYQLENYCN

SEQ ID NO: 426 - protein, 58 aa, Unknown
  Description of Unknown: single-chain insulin receptor binding polypeptide
  MOD_RES (1)..(1): UL-
FVNQHLCGSHLVEALYLVCGERGFFGSGSSSAAKPQTGIVEQCCTSICSLYQLENYCN

SEQ ID NO: 427 - protein, 58 aa, Unknown; identical to SEQ ID NO: 139
  Description of Unknown: single-chain insulin receptor binding polypeptide
  MOD_RES (1)..(1): UL-

SEQ ID NO: 428 - protein, 58 aa, Unknown
  Description of Unknown: single-chain insulin receptor binding polypeptide
  MOD_RES (1)..(1): UL-
FVNQHLCGSHLVEALYLVCGERGFFGSGSSSKAAPQTGIVEQCCTSICSLYQLENYCN

SEQ ID NO: 429 - protein, 59 aa, Unknown
  Description of Unknown: single-chain insulin receptor binding polypeptide
  MOD_RES (1)..(1): UL-
FVNQHLCGSHLVEALYLVCGERGFFGSGSSSAAAPQTGIVEQCCTSICSLYQLENYCNK

SEQ ID NO: 430 - protein, 58 aa, Unknown
  Description of Unknown: single-chain insulin receptor binding polypeptide
FVNQHLCGSHLVEALYLVCGERGFFGSGSSSAAAPQTGIVEQCCTSICSLYQLENYCN

SEQ ID NO: 431 - protein, 152 aa, Unknown
  Description of Unknown: interleukin-1 receptor antagonistic protein
  MOD_RES (1)..(1): UL-
  MOD_RES (66)..(69): cysteine or serine
  MOD_RES (84)..(84): cysteine or asparagine
  MOD_RES (116)..(122): cysteine or serine
RPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDE

SEQ ID NO: 432 - protein, 153 aa, Unknown
  Description of Unknown: interleukin-1 receptor antagonistic protein
  MOD_RES (1)..(1): UL-
  MOD_RES (67)..(67): Xaa can be any naturally occurring amino acid
  MOD_RES (70)..(123): cysteine or serine
CRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAASPGWFLXTAMEADQPVSLTNMPDEGVMVTKFYFQEDE

SEQ ID NO: 433 - protein, 153 aa, Unknown
  Description of Unknown: interleukin-1 receptor antagonistic protein
  MOD_RES (1)..(1): UL-
  MOD_RES (66)..(122): cysteine or serine
RPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAASPGWFLXTAMEADQPVSLTNMPDEGVMVTKFYFQEDEC

SEQ ID NO: 434 - protein, 152 aa, Artificial Sequence
  Description of Artificial Sequence: Synthetic fusion protein
  MOD_RES (1)..(1): insulin receptor binding polypeptide-linking group-
  MOD_RES (66)..(122): cysteine or serine
RPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDE

SEQ ID NO: 435 - protein, 153 aa, Artificial Sequence; identical to SEQ ID NO: 432
  Description of Artificial Sequence: Synthetic fusion protein
  MOD_RES (1)..(1): insulin receptor binding polypeptide - linking group
  MOD_RES (67)..(123): cysteine or serine

SEQ ID NO: 436 - protein, 5 aa, Unknown
  Description of Unknown: short peptide of Lj
GGGGS

SEQ ID NO: 437 - protein, 10 aa, Unknown
  Description of Unknown: short peptide
GPSSGAPPPS

SEQ ID NO: 438 - protein, 9 aa, Unknown
  Description of Unknown: short peptide
PSSGAPPPS

SEQ ID NO: 439 - protein, 43 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methyl- histidine, imidazole acetic acid, deamino-histidine,
  MOD_RES (1)..(1): hydroxylhistidine, acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (7)..(7): isoleucine, or threonine
  MOD_RES (10)..(10): tyrosine, tryptophan, phenylalanine, valine, lysine, ornithine, glutamic acid, leucine, general formula 1, or general formula 2
  MOD_RES (12)..(12): isoleucine, serine, lysine, arginine, general formula 1, or general formula 2
  MOD_RES (13)..(13): alanine, glutamine, or tyrosine
  MOD_RES (14)..(14): methionine or leucine
  MOD_RES (16)..(16): lysine, arginine, serine, glutamic acid, glutamine, homo-glutamic acid, homoecysteine, threonine, glycine, 2-methylalanine, general formula 1, or general formula 2
  MOD_RES (17)..(17): isoleucine, glutamine, glutamic acid, arginine, general formula 1, or general formula 2
  MOD_RES (18)..(18): histidine, alanine, arginine, serine, threonine, or glycine
  MOD_RES (20)..(20): glutamine, lysine, alanine, serine, threonine, citrulline, arginine, ornithine, 2-methylalanine, other alpha,alpha- disubtituted amino acids, general formula 1, or general formula 2
  MOD_RES (21)..(21): aspartic acid, glutamic acid, homo-glutamic acid, homoecysteine, leucine, general formula 1, or general formula 2
  MOD_RES (23)..(23): valine, or isoleucine
  MOD_RES (24)..(24): glutamine, glutamic acid, asparagine, alanine, serine, threonine, 2-methylalanine, general formula 1, or general formula 2
  MOD_RES (27)..(27): leucine, isoleucine, norleucine, lysine, valine, methionine, general formula 1, or general formula 2
  MOD_RES (28)..(28): glycine, alanine, lysine, asparagine, general formula 1, or general formula 2
  MOD_RES (29)..(29): glutamine, glycine, threonine, alanine, general formula 1, or general formula 2
  MOD_RES (30)..(30): lysine, arginine, glycine, general formula 1, or general formula 2
  MOD_RES (31)..(31): -NH2, glycine, proline, or absent
  MOD_RES (32)..(32): lysine, arginine, serine, general formula 1, general formula 2, or absent
  MOD_RES (33)..(33): lysine, arginine, serine, general formula 1, general formula 2, or absent
  MOD_RES (34)..(34): asparagine, glycine, or absent
  MOD_RES (35)..(35): asparagine, alanine, or absent
  MOD_RES (36)..(36): tryptophan, proline, or absent
  MOD_RES (37)..(37): lysine, arginine, proline, general formula 1, general formula 2, or absent
  MOD_RES (38)..(38): histidine, proline, or absent
  MOD_RES (39)..(39): asparagine, serine, or absent
  MOD_RES (40)..(40): isoleucine,-NH2, general formula 1, general formula 2, or absent
  MOD_RES (41)..(41): threonine or absent
  MOD_RES (42)..(42): glutamine or absent
  MOD_RES (43)..(43): lysine, cysteine, PSSGAPPPS, general formula 3, general formula 4, or absent
XXXGTXXSDXSXXXDXXXQXXFXXWLXXXXXXXXXXXXXXXXX

SEQ ID NO: 440 - protein, 10 aa, Unknown
  Description of Unknown: short peptide
  MOD_RES (1)..(1): formula 1 or formula 2
XPSSGAPPPS

SEQ ID NO: 441 - protein, 9 aa, Unknown
  Description of Unknown: short peptide
  MOD_RES (9)..(9): formula 1 or formula 2
  MOD_RES (9)..(9): NH2-
PSSGAPPPX

SEQ ID NO: 442 - protein, 10 aa, Unknown
  Description of Unknown: short peptide
  MOD_RES (10)..(10): formula 1 or formula 2
  MOD_RES (10)..(10): NH2-
PSSGAPPPSX

SEQ ID NO: 443 - protein, 196 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (1)..(1): UL-
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (7)..(7): isoleucine, or threonine
  MOD_RES (10)..(10): tyrosine, tryptophan, phenylalanine, valine, lysine, ornithine, glutamic acid, leucine, general formula 1, or general formula 2
  MOD_RES (12)..(12): isoleucine, serine, lysine, arginine, general formula 1, or general formula 2
  MOD_RES (13)..(13): alanine, glutamine, or tyrosine
  MOD_RES (14)..(14): methionine or leucine
  MOD_RES (16)..(16): lysine, arginine, serine, glutamic acid, glutamine, homo-glutamic acid, homoecysteine, threonine, glycine, 2-methylalanine, general formula 1, or general formula 2
  MOD_RES (17)..(17): isoleucine, glutamine, glutamic acid, arginine, general formula 1, or general formula 2
  MOD_RES (18)..(18): histidine, alanine, arginine, serine, threonine, or glycine
  MOD_RES (20)..(20): glutamine, lysine, alanine, serine, threonine, citrulline, arginine, ornithine, 2-methylalanine, other alpha,alpha- disubtituted amino acids, general formula 1, or general formula 2
  MOD_RES (21)..(21): aspartic acid, glutamic acid, homo-glutamic acid, homoecysteine, leucine, general formula 1, or general formula 2
  MOD_RES (23)..(23): valine, or isoleucine
  MOD_RES (24)..(24): glutamine, glutamic acid, asparagine, alanine, serine, threonine, 2-methylalanine, general formula 1, or general formula 2
  MOD_RES (27)..(27): leucine, isoleucine, norleucine, lysine, valine, methionine, general formula 1, or general formula 2
  MOD_RES (28)..(28): glycine, alanine, lysine, asparagine, general formula 1, or general formula 2
  MOD_RES (29)..(29): glutamine, glycine, threonine, alanine, general formula 1, or general formula 2
  MOD_RES (30)..(30): lysine, arginine, glycine, general formula 1, or general formula 2
  MOD_RES (31)..(31): -NH2, glycine, proline, or absent
  MOD_RES (32)..(32): lysine, arginine, serine, general formula 1, general formula 2, or absent
  MOD_RES (33)..(33): lysine, arginine, serine, general formula 1, general formula 2, or absent
  MOD_RES (34)..(34): asparagine, glycine, or absent
  MOD_RES (35)..(35): asparagine, alanine, or absent
  MOD_RES (36)..(36): tryptophan, proline, or absent
  MOD_RES (37)..(37): lysine, arginine, proline, general formula 1, general formula 2, or absent
  MOD_RES (38)..(38): histidine, proline, or absent
  MOD_RES (39)..(39): asparagine, serine, or absent
  MOD_RES (40)..(40): isoleucine,-NH2, general formula 1, general formula 2, or absent
  MOD_RES (41)..(41): threonine or absent
  MOD_RES (42)..(42): glutamine or absent
  MOD_RES (43)..(43): lysine, cysteine, PSSGAPPPS, general formula 3, general formula 4, or absent
  MOD_RES (43)..(44): Xaa43 and Xaa44 are linked by Lj
  MOD_RES (44)..(44): methionine, cysteine, general formula 1, general formula 2 or absent
  MOD_RES (110)..(113): cysteine or serine
  MOD_RES (128)..(128): cysteine or asparagine
  MOD_RES (160)..(166): cysteine or serine
XXXGTXXSDXSXXXDXXXQXXFXXWLXXXXXXXXXXXXXXXXXXRPSGRKSSKMQAFRIWDVNQKTFYLRNNQLVAGYLQGPNVNLEEKIDVVPIEPHALFLGIHGGKMXLSXVKSGDETRLQLEAVXITDLSENRKQDKRFAFIRSDSGPTTSFESAAXPGWFLXTAMEADQPVSLTNMPDEGVMVTKFYFQEDE

SEQ ID NO: 444 - protein, 264 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (1)..(1): UL-
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (10)..(10): tyrosine, tryptophan, phenylalanine, valine, lysine, ornithine, glutamic acid, leucine, general formula 1, or general formula 2
  MOD_RES (12)..(12): isoleucine, serine, lysine, arginine, general formula 1, or general formula 2
  MOD_RES (16)..(16): lysine, arginine, serine, glutamic acid, glutamine, homo-glutamic acid, homoecysteine, threonine, glycine, 2-methylalanine, general formula 1, or general formula 2
  MOD_RES (27)..(27): leucine, isoleucine, norleucine, lysine, valine, methionine, general formula 1, or general formula 2
  MOD_RES (28)..(28): glycine, alanine, lysine, asparagine, general formula 1, or general formula 2
  MOD_RES (30)..(30): lysine, arginine, glycine, general formula 1, or general formula 2
  MOD_RES (31)..(42): P43 to S51 are repeated for 0 or 1 time
  MOD_RES (32)..(32): lysine, arginine, serine, general formula 1, general formula 2, or absent
  MOD_RES (33)..(33): lysine, arginine, serine, general formula 1, general formula 2, or absent
  MOD_RES (37)..(37): lysine, arginine, proline, general formula 1, general formula 2, or absent
  MOD_RES (43)..(51): P43 to S51 are repeated for 0 or 1 time
  MOD_RES (52)..(81): "GGGGS" is repeated for 0, 1, 2, 3, 4, 5 or 6 times
  MOD_RES (82)..(82): cysteine, lysine, absent, general formula 1, or general formula 2
  MOD_RES (83)..(112): "GGGGS" is repeated for 0, 1, 2, 3, 4, 5 or 6 times
  MOD_RES (196)..(196): cysteine or asparagine
  MOD_RES (228)..(228): cysteine or serine
XXXGTXISDXSXAMDXIHQQDFVNWLXXQXGXXNDWXHNITQPSSGAPPPSGGGGSGGGGSGGGGSGGGGSGGGGSGGGGSXGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVXITDLSENRKQDKRFAFIRSDSGPTTSFESAAXPGWFLCTAMEADQPVSLTNMPDEGVMVTKFYFQEDE

SEQ ID NO: 445 - protein, 264 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(1): UL-
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (31)..(42): G31 to Q42 are repeated for 0 or 1 time
  MOD_RES (43)..(51): P43 to S51 are repeated for 0 or 1 time
  MOD_RES (52)..(81): "GGGGS" is repeated for 0, 1, 2, 3, 4, 5 or 6 times
  MOD_RES (82)..(82): cysteine, lysine, absent, general formula 1, or general formula 2
  MOD_RES (83)..(112): "GGGGS" is repeated for 0, 1, 2, 3, 4, 5 or 6 times
  MOD_RES (196)..(196): cysteine or asparagine
  MOD_RES (228)..(228): cysteine or serine
XXXGTFISDYSIAMDKIHQQDFVNWLLAQKGKKNDWKHNITQPSSGAPPPSGGGGSGGGGSGGGGSGGGGSGGGGSGGGGSXGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVXITDLSENRKQDKRFAFIRSDSGPTTSFESAAXPGWFLCTAMEADQPVSLTNMPDEGVMVTKFYFQEDE

SEQ ID NO: 446 - protein, 259 aa, Artificial Sequence
  Description of Artificial Sequence: Synthetic fusion protein
  MOD_RES (1)..(1): phenylalanine, or absent
  MOD_RES (1)..(1): UL-
  MOD_RES (26)..(37): G26 to Q37 are repeated for 0 or 1 time
  MOD_RES (38)..(46): P38 to S46 are repeated for 0 or 1 time
  MOD_RES (47)..(76): "GGGGS" is repeated for 0, 1, 2, 3, 4, 5 or 6 times
  MOD_RES (77)..(77): cysteine, lysine, absent, general formula 1, or general formula 2
  MOD_RES (78)..(107): "GGGGS" is repeated for 0, 1, 2, 3, 4, 5 or 6 times
  MOD_RES (191)..(191): cysteine or asparagine
  MOD_RES (223)..(223): cysteine or serine
XISDYSIAMDKIHQQDFVNWLLAQKGKKNDWKHNITQPSSGAPPPSGGGGSGGGGSGGGGSGGGGSGGGGSGGGGSXGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVXITDLSENRKQDKRFAFIRSDSGPTTSFESAAXPGWFLCTAMEADQPVSLTNMPDEGVMVTKFYFQEDE

SEQ ID NO: 447 - protein, 848 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (1)..(1): acetylhistidine,homohistidine, N-palmitic acid-tyrosine, N-Fmoc-tyrosine,or absent
  MOD_RES (1)..(5): Xaa1 to T5 are repeated for 0 or 1 time
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (31)..(42): G31 to Q42 are repeated for 0 or 1 time
  MOD_RES (43)..(51): P43 to S51 are repeated for 0 or 1 time
  MOD_RES (52)..(81): "GGGGS" is repeated for 0, 1, 2, 3, 4, 5 or 6 times
  MOD_RES (667)..(696): "GGGGS" is repeated for 0, 1, 2, 3, 4, 5 or 6 times
XXXGTXISDYSIAMDKIHQQDFVNWLLAQKGKKNDWKHNITQPSSGAPPPSGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 448 - protein, 848 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (31)..(42): G31 to Q42 are repeated for 0 or 1 time
  MOD_RES (43)..(51): P43 to S51 are repeated for 0 or 1 time
  MOD_RES (52)..(81): "GGGGS" is repeated for 0, 1, 2, 3, 4, 5 or 6 times
  MOD_RES (234)..(263): "GGGGS" is repeated for 0, 1, 2, 3, 4, 5 or 6 times
XXXGTXISDYSIAMDKIHQQDFVNWLLAQKGKKNDWKHNITQPSSGAPPPSGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 449 - protein, 899 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (31)..(42): G31 to Q42 are repeated for 0 or 1 time
  MOD_RES (43)..(51): P43 to S51 are repeated for 0 or 1 time
  MOD_RES (52)..(52): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (52)..(52): acetylhistidine, homohistidine, N-palmitic acid-tyrosine, N-Fmoc-tyrosine, or absent
  MOD_RES (52)..(56): Xaa52 to T56 are repeated for 0 or 1 time
  MOD_RES (53)..(53): alanine, D-alanine, D-serine, serine, valine, glycine, N-methylserine, N-methylalanine, 2-methylalanine, or absent
  MOD_RES (54)..(54): glutamic acid, hydroxyl proline, proline, or absent
  MOD_RES (57)..(57): phenylalanine, or absent
  MOD_RES (82)..(93): G82 to Q93 are repeated for 0 or 1 time
  MOD_RES (94)..(102): P94 to S102 are repeated for 0 or 1 time
  MOD_RES (103)..(132): "GGGGS" is repeated for 0, 1, 2, 3, 4, 5 or 6 times
  MOD_RES (285)..(314): "GGGGS" is repeated for 0, 1, 2, 3, 4, 5 or 6 times
XXXGTXISDYSIAMDKIHQQDFVNWLLAQKGKKNDWKHNITQPSSGAPPPSXXXGTXISDYSIAMDKIHQQDFVNWLLAQKGKKNDWKHNITQPSSGAPPPSGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 450 - protein, 899 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (31)..(42): G31 to Q42 are repeated for 0 or 1 time
  MOD_RES (43)..(51): P43 to S51 are repeated for 0 or 1 time
  MOD_RES (52)..(52): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (52)..(52): acetylhistidine,
  MOD_RES (52)..(56): Xaa52 to T56 are repeated for 0 or 1 time
  MOD_RES (53)..(53): alanine, D-alanine, D-serine, serine, valine, glycine, N-methylserine, N-methylalanine, 2-methylalanine, or absent
  MOD_RES (54)..(54): glutamic acid, hydroxyl proline, proline, or absent
  MOD_RES (57)..(57): phenylalanine, or absent
  MOD_RES (82)..(93): G82 to Q93 are repeated for 0 or 1 time
  MOD_RES (94)..(102): P94 to S102 are repeated for 0 or 1 time
  MOD_RES (103)..(132): "GGGGS" is repeated for 0, 1, 2, 3, 4, 5 or 6 times
  MOD_RES (718)..(747): "GGGGS" is repeated for 0, 1, 2, 3, 4, 5 or 6 times
XXXGTXISDYSIAMDKIHQQDFVNWLLAQKGKKNDWKHNITQPSSGAPPPSXXXGTXISDYSIAMDKIHQQDFVNWLLAQKGKKNDWKHNITQPSSGAPPPSGGGGSGGGGSGGGGSGGGGSGGGGSGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 451 - protein, 496 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid (DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (31)..(42): G31 to Q42 are repeated for 0 or 1 time
  MOD_RES (43)..(51): P43 to S51 are repeated for 0 or 1 time
  MOD_RES (52)..(81): "GGGGS" is repeated for 0, 1, 2, 3, 4, 5 or 6 times
  MOD_RES (234)..(263): "GGGGS" is repeated for 0, 1, 2, 3, 4, 5 or 6 times
XXXGTXISDYSIAMDKIHQQDFVNWLLAQKGKKNDWKHNITQPSSGAPPPSGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDEGGGGSGGGGSGGGGSGGGGSGGGGSGGGGSAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 452 - protein, 496 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (31)..(42): G31 to Q42 are repeated for 0 or 1 time
  MOD_RES (43)..(51): P43 to S51 are repeated for 0 or 1 time
  MOD_RES (52)..(81): "GGGGS" is repeated for 0, 1, 2, 3, 4, 5 or 6 times
  MOD_RES (315)..(344): "GGGGS" is repeated for 0, 1, 2, 3, 4, 5 or 6 times
XXXGTXISDYSIAMDKIHQQDFVNWLLAQKGKKNDWKHNITQPSSGAPPPSGGGGSGGGGSGGGGSGGGGSGGGGSGGGGSAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 453 - protein, 492 aa, Artificial Sequence
  Description of Artificial Sequence: Synthetic fusion protein
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (31)..(42): G31 to Q42 are repeated for 0 or 1 time
  MOD_RES (43)..(51): P43 to S51 are repeated for 0 or 1 time
  MOD_RES (52)..(81): "GGGGS" is repeated for 0, 1, 2, 3, 4, 5 or 6 times
  MOD_RES (197)..(197): cysteine or serine
  MOD_RES (234)..(263): "GGGGS" is repeated for 0, 1, 2, 3, 4, 5 or 6 times
XXXGTXISDYSIAMDKIHQQDFVNWLLAQKGKKNDWKHNITQPSSGAPPPSGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAAXPGWFLCTAMEADQPVSLTNMPDEGVMVTKFYFQEDEGGGGSGGGGSGGGGSGGGGSGGGGSGGGGSAESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 454 - protein, 153 aa, Artificial Sequence; identical to SEQ ID NO: 268
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (117)..(117): -linking group-GIP receptor binding polypeptide

SEQ ID NO: 455 - protein, 153 aa, Artificial Sequence; identical to SEQ ID NO: 269
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (85)..(85): -linking group-GIP receptor binding polypeptide

SEQ ID NO: 456 - protein, 51 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (1)..(5): Xaa1 to T5 are repeated for 0 or 1 time
  MOD_RES (1)..(1): UL-
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (6)..(6): phenylalanine, or absent
  MOD_RES (10)..(10): tyrosine, tryptophan, phenylalanine, valine, lysine, ornithine, glutamic acid, leucine, general formula 1, or general formula 2
  MOD_RES (12)..(12): isoleucine, serine, lysine, arginine, general formula 1, or general formula 2
  MOD_RES (16)..(16): lysine, arginine, serine, glutamic acid, glutamine, homo-glutamic acid, homoecysteine, threonine, glycine, 2-methylalanine, general formula 1, or general formula 2
  MOD_RES (27)..(27): leucine, isoleucine, norleucine, lysine, valine, methionine, general formula 1, or general formula 2
  MOD_RES (28)..(28): glycine, alanine, lysine, asparagine, general formula 1, or general formula 2
  MOD_RES (30)..(30): lysine, arginine, glycine, general formula 1, or general formula 2
  MOD_RES (31)..(42): G31 to Q42 are repeated for 0 or 1 time
  MOD_RES (32)..(32): lysine, arginine, serine, general formula 1, general formula 2, or absent
  MOD_RES (33)..(33): lysine, arginine, serine, general formula 1, general formula 2, or absent
  MOD_RES (37)..(37): lysine, arginine, proline, general formula 1, general formula 2, or absent
  MOD_RES (43)..(51): P43 to S51 are repeated for 0 or 1 time
XXXGTXISDXSXAMDXIHQQDFVNWLXXQXGXXNDWXHNITQPSSGAPPPS

SEQ ID NO: 457 - protein, 43 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDKIHQQDFVNWLLAQKGKKNDWKHNITQC

SEQ ID NO: 458 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDKIHQQDFVNWLLAQKGKKNDWCHNITQ

SEQ ID NO: 459 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDKIHQQDFVNWLLAQKGKCNDWKHNITQ

SEQ ID NO: 460 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDKIHQQDFVNWLLAQKGCKNDWKHNITQ

SEQ ID NO: 461 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDKIHQQDFVNWLLAQCGKKNDWKHNITQ

SEQ ID NO: 462 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDCIHQQDFVNWLLAQKGKKNDWKHNITQ

SEQ ID NO: 463 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSCAMDKIHQQDFVNWLLAQKGKKNDWKHNITQ

SEQ ID NO: 464 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDCSIAMDKIHQQDFVNWLLAQKGKKNDWKHNITQ

SEQ ID NO: 465 - protein, 31 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDKIHQQDFVNWLLAQKC

SEQ ID NO: 466 - protein, 30 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (30)..(30): -NH2
XXXGTFISDYSIAMDCIHQQDFVNWLLAQK

SEQ ID NO: 467 - protein, 40 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDKIHQQDFVNWLLAQKPSSGAPPPSC

SEQ ID NO: 468 - protein, 39 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (39)..(39): -NH2
XXXGTFISDYSIAMDKIHQQDFVNWLLAQKPSSGAPPPC

SEQ ID NO: 469 - protein, 39 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (39)..(39): -NH2
XXXGTFISDYSIAMDKIHQQDFVNWLLAQCPSSGAPPPS

SEQ ID NO: 470 - protein, 39 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (39)..(39): -NH2
XXXGTFISDYSIAMDCIHQQDFVNWLLAQKPSSGAPPPS

SEQ ID NO: 471 - protein, 39 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (39)..(39): -NH2
XXXGTFISDYSCAMDKIHQQDFVNWLLAQKPSSGAPPPS

SEQ ID NO: 472 - protein, 39 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (39)..(39): -NH2
XXXGTFISDCSIAMDKIHQQDFVNWLLAQKPSSGAPPPS

SEQ ID NO: 473 - protein, 26 aa, Unknown
  Description of Unknown: GIP receptor binding polypeptide
FISDYSIAMDKIHQQDFVNWLLAQKC

SEQ ID NO: 474 - protein, 25 aa, Unknown
  Description of Unknown: GIP receptor binding polypeptide
  MOD_RES (25)..(25): -NH2
FISDYSIAMDKIHQQDFVNWLLAQC

SEQ ID NO: 475 - protein, 25 aa, Unknown
  Description of Unknown: GIP receptor binding polypeptide
  MOD_RES (25)..(25): -NH2
FISDYSIAMDCIHQQDFVNWLLAQK

SEQ ID NO: 476 - protein, 24 aa, Unknown
  Description of Unknown: GIP receptor binding polypeptide
  MOD_RES (24)..(24): -NH2
ISDYSIAMDKIHQQDFVNWLLAQC

SEQ ID NO: 477 - protein, 24 aa, Unknown
  Description of Unknown: GIP receptor binding polypeptide
  MOD_RES (24)..(24): -NH2
ISDYSIAMDCIHQQDFVNWLLAQK

SEQ ID NO: 478 - protein, 43 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDRIHQQDFVNWLLAQRGRRNDWRHNITQK

SEQ ID NO: 479 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absen
  MOD_RES (3)..(3): glutamic acid, hydroxyl proline, proline, or absent
XXXGTFISDYSIAMDRIHQQDFVNWLLAQRGRRNDWKHNITQ

SEQ ID NO: 480 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDRIHQQDFVNWLLAQRGRKNDWRHNITQ

SEQ ID NO: 481 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDRIHQQDFVNWLLAQRGKRNDWRHNITQ

SEQ ID NO: 482 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDRIHQQDFVNWLLAQKGRRNDWRHNITQ

SEQ ID NO: 483 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSIAMDKIHQQDFVNWLLAQRGRRNDWRHNITQ

SEQ ID NO: 484 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDYSKAMDRIHQQDFVNWLLAQRGRRNDWRHNITQ

SEQ ID NO: 485 - protein, 42 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
XXXGTFISDKSIAMDRIHQQDFVNWLLAQRGRRNDWRHNITQ

SEQ ID NO: 486 - protein, 40 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absen
  MOD_RES (3)..(3): glutamic acid, hydroxyl proline, proline, or absent
XXXGTFISDYSIAMDRIHQQDFVNWLLAQRPSSGAPPPSK

SEQ ID NO: 487 - protein, 39 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (39)..(39): -NH2
XXXGTFISDYSIAMDRIHQQDFVNWLLAQRPSSGAPPPK

SEQ ID NO: 488 - protein, 39 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (39)..(39): -NH2
XXXGTFISDYSIAMDRIHQQDFVNWLLAQKPSSGAPPPS

SEQ ID NO: 489 - protein, 39 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (39)..(39): -NH2
XXXGTFISDYSIAMDKIHQQDFVNWLLAQRPSSGAPPPS

SEQ ID NO: 490 - protein, 39 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (39)..(39): -NH2
XXXGTFISDKSIAMDRIHQQDFVNWLLAQRPSSGAPPPS

SEQ ID NO: 491 - protein, 30 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (30)..(30): -NH2
XXXGTFISDYSIAMDRIHQQDFVNWLLAQK

SEQ ID NO: 492 - protein, 30 aa, Unknown
  Description of Unknown: GIP receptor binding polypeptide
  MOD_RES (1)..(1): tyrosine, N-acetyl tyrosine, pyroglutamyl-tyrosine, glucitol-tyrosine, D-histidine, alpha-2 methylimidazolyl acetic acid(DMIA), N-methylhistidine, alpha-methylhistidine, imidazole acetic acid, deamino-histidine, hydroxylhistidine,
  MOD_RES (1)..(1): acetylhistidine, homohistidine, N-palmitic acid-tyrosine, N-Fmoc-tyrosine, or absent
  MOD_RES (2)..(2): alanine, D-alanine, D-serine, serine, valine, glycine, N-methylserine, N-methylalanine, 2-methylalanine, or absent
  MOD_RES (3)..(3): glutamic acid, hydroxyl proline, proline, or absent
  MOD_RES (30)..(30): -NH2
XXXGTFISDYSIAMDKIHQQDFVNWLLAQR

SEQ ID NO: 493 - protein, 25 aa, Unknown
  Description of Unknown: GIP receptor binding polypeptide
  MOD_RES (25)..(25): -NH2
FISDYSIAMDRIHQQDFVNWLLAQK

SEQ ID NO: 494 - protein, 25 aa, Unknown
  Description of Unknown: GIP receptor binding polypeptide
  MOD_RES (25)..(25): -NH2
FISDYSIAMDKIHQQDFVNWLLAQR

SEQ ID NO: 495 - protein, 24 aa, Unknown
  Description of Unknown: GIP receptor binding polypeptide
  MOD_RES (24)..(24): -NH2
ISDYSIAMDRIHQQDFVNWLLAQK

SEQ ID NO: 496 - protein, 24 aa, Unknown
  Description of Unknown: GIP receptor binding polypeptide
  MOD_RES (24)..(24): -NH2
ISDYSIAMDKIHQQDFVNWLLAQR

SEQ ID NO: 497 - protein, 154 aa, Artificial Sequence
  Description of Artificial Sequence: Synthetic fusion protein
  MOD_RES (1)..(1): cysteine or absent
  MOD_RES (1)..(1): GIP-1 receptor binding polypeptide - linking group-
  MOD_RES (2)..(2): methionine, cysteine, general formula 1, general formula 2 or absent
  MOD_RES (86)..(86): cysteine or asparagine
  MOD_RES (118)..(118): cysteine or serine
XXRPSGRKSSKMQAFRIWDVNQKTFYLRNNQLVAGYLQGPNVNLEEKIDVVPIEPHALFLGIHGGKMCLSCVKSGDETRLQLEAVXITDLSENRKQDKRFAFIRSDSGPTTSFESAAXPGWFLCTAMEADQPVSLTNMPDEGVMVTKFYFQEDE

SEQ ID NO: 498 - protein, 154 aa, Artificial Sequence
  Description of Artificial Sequence: Synthetic fusion protein
  MOD_RES (1)..(1): methionine, cysteine, general formula 1, general formula 2 or absent
  MOD_RES (1)..(1): UL-
  MOD_RES (85)..(85): cysteine or asparagine
  MOD_RES (117)..(117): cysteine or serine
  MOD_RES (153)..(153): cysteine or absent
  MOD_RES (153)..(153): -linking group - GIP receptor binding polypeptide
  MOD_RES (154)..(154): Xaa can be any naturally occurring amino acid
XRPSGRKSSKMQAFRIWDVNQKTFYLRNNQLVAGYLQGPNVNLEEKIDVVPIEPHALFLGIHGGKMCLSCVKSGDETRLQLEAVXITDLSENRKQDKRFAFIRSDSGPTTSFESAAXPGWFLCTAMEADQPVSLTNMPDEGVMVTKFYFQEDEX

SEQ ID NO: 499 - protein, 848 aa, Artificial Sequence
  Description of Artificial Sequence: Synthetic fusion protein
  MOD_RES (586)..(615): "GGGGS" is repeated for 0, 1, 2, 3, 4, 5 or 6 times
  MOD_RES (681)..(681): cysteine or serine
  MOD_RES (684)..(684): cysteine or serine
  MOD_RES (731)..(731): cysteine or serine
  MOD_RES (737)..(737): cysteine or serine
  MOD_RES (768)..(797): "GGGGS" is repeated for 0, 1, 2, 3, 4, 5 or 6 times
  MOD_RES (827)..(828): T827 and G828 are linked by CL
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGGSGGGGSGGGGSGGGGSGGGGSRPSGRKSSKMQAFRIWDVNQKTFYLRNNQLVAGYLQGPNVNLEEKIDVVPIEPHALFLGIHGGKMXLSXVKSGDETRLQLEAVNITDLSENRKQDKRFAFIRSDSGPTTSFESAAXPGWFLXTAMEADQPVSLTNMPDEGVMVTKFYFQEDEGGGGSGGGGSGGGGSGGGGSGGGGSGGGGSFVNQHLCGSHLVEALYLVCGERGFFYTPKTGIVEQCCTSICSLYQLENYCN

SEQ ID NO: 500 - DNA, 534 bp, Homo sapiens
atggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtag

SEQ ID NO: 501 - protein, 177 aa, Homo sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 502 - DNA, 29 bp, Artificial Sequence
  Description of Artificial Sequence: Synthetic forward primer of IL-1ra
ggcggtctctaggtatggaaatctgcaga

SEQ ID NO: 503 - DNA, 29 bp, Artificial Sequence
  Description of Artificial Sequence: Synthetic forward primer of IL-1ra
ggcggtctctaggtcgaccctctgggaga

SEQ ID NO: 504 - DNA, 27 bp, Artificial Sequence
  Description of Artificial Sequence: Synthetic reverse primer of IL-1ra
ggcggatccttactactcgtcctcctg

SEQ ID NO: 505 - DNA, 677 bp, Artificial Sequence
  Description of Artificial Sequence: Synthetic cDNA of fusion polypeptide of insulin receptor binding polypeptde-linking group-IL-1Ra
tttgtcaatcagcacctttgtggttctcacctggtggaggctctgtacctggtgtgtggggaacgtggtttcttctacacacccaagaccggctcgggctcgtcgtcggctgctgctccccagaccggcattgtggagcagtgctgcaccagcatctgctccctctaccaactggagaactactgcaacggcggcggcggctcgggcggcggcggctcgcgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattcacttccaggaggacgagtag

SEQ ID NO: 506 - DNA, 606 bp, Artificial Sequence
  Description of Artificial Sequence: Synthetic cDNA of fusion protein of Exendin-4-linking group-IL-1Ra
catggtgaaggaacatttaccagtgacttgtcaaaacagatggaagaggaggcagtgcggttatttattgagtggcttaagaacggaggaccaagtagcggggcacctccgccatcgggcggcggcggctcgggcggcggcggctcgcgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtag

SEQ ID NO: 507 - DNA, 579 bp, Artificial Sequence
  Description of Artificial Sequence: Synthetic cDNA of fusion protein of GLP-1 receptor binding polypeptide -linking group-IL-1Ra
catggtgaaggaacatttaccagtgacgtgtcgtcgtacctcgaggagcaggctgctaaggagtttattgcttggctcgtgaagggccgaggcggcggcggctcgggcggcggcggctcgcgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtag

SEQ ID NO: 508 - DNA, 33 bp, Artificial Sequence
  Description of Artificial Sequence: Synthetic forward primer of GLP-1
ggcggtctctaggtcatggtgaaggaacattta

SEQ ID NO: 509 - DNA, 58 bp, Artificial Sequence
  Description of Artificial Sequence: Synthetic reverse primer of GLP-1
cagagggtcgcgagccgccgccgcccgagccgccgccgcctcggcccttcacgagcca

SEQ ID NO: 510 - DNA, 54 bp, Artificial Sequence
  Description of Artificial Sequence: Synthetic forward primer of IL-1Ra
ggccgaggcggcggcggctcgggcggcggcggctcgcgaccctctgggagaaaa

SEQ ID NO: 511 - DNA, 37 bp, Artificial Sequence
  Description of Artificial Sequence: Synthetic reverse primer of IL-1Ra
ggcggatccctactcgtcctcctggaagtagaatttg

SEQ ID NO: 512 - DNA, 1758 bp, Homo sapiens
gatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacgttcaccttccatgcagatatatgcacactttctgagaaggagagacaaatcaagaaacaaactgcacttgttgagcttgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataa

SEQ ID NO: 513 - protein, 585 aa, Homo sapiens [sequence omitted]

SEQ ID NO: 514 - DNA, 615 bp, Artificial Sequence
  Description of Artificial Sequence: Synthetic cDNA of fusion protein of GIP-linking group-IL-1Ra
tacgcggaagggactttcatcagtgactacagtattgccatggacaagattcaccaacaagactttgtgaactggctgctggcccaaaaggggaagaagaatgactggaaacacaacatcacccagggcggcggcggctcgggcggcggcggctcgcgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtag

SEQ ID NO: 515 - protein, 14 aa, Unknown
  Description of Unknown: Peptide in IL-1Ra
KMQAFRIWDVNQKT

SEQ ID NO: 516 - DNA, 579 bp, Unknown
  Description of Unknown: Polynucleotide sequence for partial peptide of fusion protein G-20
catggcgagggcaccttcacaagcgacgtgagtagctacctggaggagcaggccgccaaggagttcatcgcctggctggttaagggccgcggtggtggtggtagtggtggcggtggtagtcgtcctagcggccgcaagagcagtaagatgcaggcctttcgcatctgggacgtgaaccagaagaccttctacctgcgtaacaaccaactggtggccggctacttacagggcccgaacgtgaacctggaggagaagatcgacgtggttccgatcgaaccgcacgccctgttcctgggcattcacggtggcaagatgtgcctgagctgcgtgaaaagcggcgacgagacacgtctgcagctggaagccgtgaacatcaccgacctgagcgaaaaccgcaagcaggacaagcgcttcgccttcatccgcagcgatagtggcccgaccaccagcttcgaaagtgccgcctgcccgggttggttcctgtgcacagcaatggaggccgaccagccggtgagcctgaccaacatgccggacgagggcgtgatggtgaccaagttttacttccaagaggacgagtaa

SEQ ID NO: 517 - DNA, 597 bp, Unknown
  Description of Unknown: Polynucleotide sequence for partial peptide of fusion protein G-20
catggcgagggcaccttcacaagcgacgtgagtagctacctggaggagcaggccgccaaggagttcatcgcctggctggttaagggccgcggtggtggtggtagtggtggcggtggtagtcgtcctagcggccgcaagagcagtaagatgcaggcctttcgcatctgggacgtgaaccagaagaccttctacctgcgtaacaaccaactggtggccggctacttacagggcccgaacgtgaacctggaggagaagatcgacgtggttccgatcgaaccgcacgccctgttcctgggcattcacggtggcaagatgtgcctgagctgcgtgaaaagcggcgacgagacacgtctgcagctggaagccgtgaacatcaccgacctgagcgaaaaccgcaagcaggacaagcgcttcgccttcatccgcagcgatagtggcccgaccaccagcttcgaaagtgccgcctgcccgggttggttcctgtgcacagcaatggaggccgaccagccggtgagcctgaccaacatgccggacgagggcgtgatggtgaccaagttttacttccaagaggacgagtaactcgagcaccaccaccac

SEQ ID NO: 518 - DNA, 459 bp, Unknown
  Description of Unknown: Polynucleotide sequence for partial peptide of native IL-1Ra
cgtcctagcggccgcaagagcagtaagatgcaggcctttcgcatctgggacgtgaaccagaagaccttctacctgcgtaacaaccaactggtggccggctacttacagggcccgaacgtgaacctggaggagaagatcgacgtggttccgatcgaaccgcacgccctgttcctgggcattcacggtggcaagatgtgcctgagctgcgtgaaaagcggcgacgagacacgtctgcagctggaagccgtgaacatcaccgacctgagcgaaaaccgcaagcaggacaagcgcttcgccttcatccgcagcgatagtggcccgaccaccagcttcgaaagtgccgcctgcccgggttggttcctgtgcacagcaatggaggccgaccagccggtgagcctgaccaacatgccggacgagggcgtgatggtgaccaagttttacttccaagaggacgagtaa

SEQ ID NO: 519 - DNA, 477 bp, Unknown
  Description of Unknown: Polynucleotide sequence for partial peptide of native IL-1Ra
cgtcctagcggccgcaagagcagtaagatgcaggcctttcgcatctgggacgtgaaccagaagaccttctacctgcgtaacaaccaactggtggccggctacttacagggcccgaacgtgaacctggaggagaagatcgacgtggttccgatcgaaccgcacgccctgttcctgggcattcacggtggcaagatgtgcctgagctgcgtgaaaagcggcgacgagacacgtctgcagctggaagccgtgaacatcaccgacctgagcgaaaaccgcaagcaggacaagcgcttcgccttcatccgcagcgatagtggcccgaccaccagcttcgaaagtgccgcctgcccgggttggttcctgtgcacagcaatggaggccgaccagccggtgagcctgaccaacatgccggacgagggcgtgatggtgaccaagttttacttccaagaggacgagtaactcgagcaccaccaccac

SEQ ID NO: 520 - DNA, 580 bp, Unknown
  Description of Unknown: IL-1RaIL-1ra-full and IL-1ra-SEQ
catggcgagggcaccttcacaagcgacgtgagtagctacctggaggagcaggccgccaaggagttcatcgcctggctggttaagggccgcggtggtggtggtagtggtggcggtggtagtcgtccctagcggccgcaagagcagtaagatgcaggcctttcgcatctgggacgtgaaccagaagaccttctacctgcgtaacaaccaactggtggccggctacttacagggcccgaacgtgaacctggaggagaagatcgacgtggttccgatcgaaccgcacgccctgttcctgggcattcacggtggcaagatgtgcctgagctgcgtgaaaagcggcgacgagacacgtctgcagctggaagccgtgaacatcaccgacctgagcgaaaaccgcaagcaggacaagcgcttcgccttcatccgcagcgatagtggcccgaccaccagcttcgaaagtgccgcctgcccgggttggttcctgtgcacagcaatggaggccgaccagccggtgagcctgaccaacatgccggacgagggcgtgatggtgaccaagttttacttccaagaggacgagtaa

SEQ ID NO: 521 - DNA, 460 bp, Unknown
  Description of Unknown: IL-1ra-40 and IL-1ra-40-SE
cgtccctagcggccgcaagagcagtaagatgcaggcctttcgcatctgggacgtgaaccagaagaccttctacctgcgtaacaaccaactggtggccggctacttacagggcccgaacgtgaacctggaggagaagatcgacgtggttccgatcgaaccgcacgccctgttcctgggcattcacggtggcaagatgtgcctgagctgcgtgaaaagcggcgacgagacacgtctgcagctggaagccgtgaacatcaccgacctgagcgaaaaccgcaagcaggacaagcgcttcgccttcatccgcagcgatagtggcccgaccaccagcttcgaaagtgccgcctgcccgggttggttcctgtgcacagcaatggaggccgaccagccggtgagcctgaccaacatgccggacgagggcgtgatggtgaccaagttttacttccaagaggacgagtaa

The invention claimed is:
1. A fusion protein obtained by linking an interleukin-1 receptor antagonist protein or an analogue thereof with another polypeptide which is a GLP-1 receptor binding polypeptide or an analogue thereof, wherein the sequence of said fusion protein is:

(SEQ ID NO: 243)
$X_{G1}X_{G2}X_{G3}GX_{G5}X_{G6}TSDX_{G10}SX_{G12}YLEX_{G16}X_{G17}X_{G18}AX_{G20}X_{G21}FIX_{G24}X_{G2}$ $_5LX_{G27}X_{G28}X_{G29}X_{G30}X_{G31}-L_j-X_{IL0}RPSGRKSSKMQAFRIWDVNQKTFYL$

RNNQLVAGYLQGPNVNLEEKIDVVPIEPHALFLGIHGGKMX$_{IL66}$L

SX$_{IL69}$VKSGDETRLQLEAVX$_{IL84}$ITDLSENRKQDKRFAFIRSDGSGPTT

SFESAAX$_{IL116}$PGWFLX$_{IL122}$TAMEADQPVSLTNMPDEGVMVTKFYFQE

DE, wherein
- $X_{IL0}$ is a cysteine, general formula 1, general formula 2, or absent;
- $X_{IL66}$, $X_{IL69}$, $X_{IL116}$, $X_{IL122}$ is a cysteine or serine; $X_{IL84}$ is a cysteine or asparagine;
- $L_j$ is a linking group or spacer group, selected from a long chain fatty acid, polyethylene glycol, an amino acid, a short peptide, or absent;
- $X_{G1}$ is a histidine, D-histidine, deamino-histidine, β-hydroxyl-histidine, homohistidine, α-fluoromethyl-histidine, α-methyl-histidine, N-methyl-histidine, N$^α$-acetyl-histidine, α-methyl-histidine, 2-pyridinyl-alanine, 3-pyridinyl-alanine, 4-pyridinyl-alanine, imidazopropionyl; $X_{G2}$ is a 2-methylalanine, glycine, D-serine, serine, threonine, leucine, isoleucine, valine, aminocyclopropanecarboxylic acid, aminocyclobutanecarboxylic acid, aminocyclopentanecarboxylic acid, aminocyclohexanecarboxylic acid, aminocycloheptanecarboxylic acid, or aminocyclooctanecarboxylic acid; $X_{G3}$ is a glutamic acid, aspartic acid, or glutamine; $X_{G5}$ is a threonine, aspartic acid, glutamic acid, arginine, alanine, lysine, or histidine; $X_{G6}$ is a phenylalanine, tyrosine, tryptophan, or histidine; $X_{G10}$ is a valine, tyrosine, phenylalanine, tryptophan, histidine, leucine, isoleucine, serine, threonine, aspartic acid, glutamic acid, alanine, lysine, arginine, cysteine, general formula 1, or general formula 2; $X_{G12}$ is a serine, isoleucine, lysine, arginine, cysteine, general formula 1, or general formula 2; $X_{G16}$ is a glycine, serine, histidine, glutamic acid, aspartic acid, glutamine, asparagine, lysine, arginine, homoglutamic acid, cysteine, homocysteine, or sulfoalanine; $X_{G17}$ is a glutamine, arginine, isoleucine, glutamic acid, aspartic acid, histidine, lysine, cysteine, general formula 1, or general formula 2; $X_{G18}$ is an alanine, arginine, histidine, glutamic acid, or lysine; $X_{G20}$ is a lysine, arginine, aspartic acid, glutamic acid, glutamine, histidine, 2-methylalanine, cysteine, general formula 1, or general formula 2; $X_{G21}$ is an aspartic acid, glutamic acid, leucine, alanine, lysine, cysteine, general formula 1, or general formula 2; $X_{G24}$ is an alanine, glutamine, asparagine, glutamic acid, aspartic acid, serine, or histidine; $X_{G25}$ is an alanine, tryptophan, phenylalanine, tyrosine, cysteine, lysine, general formula 1, or general formula 2; $X_{G27}$ is a valine, leucine, lysine, arginine, alanine, glycine, cysteine, general formula 1, or general formula 2; $X_{G28}$ is a lysine, arginine, aspartic acid, glutamic acid, alanine, asparagine, cysteine, general formula 1, or general formula 2; $X_{G29}$ is a glycine, glutamine, threonine, serine, lysine, arginine, cysteine, general formula 1, or general formula 2; $X_{G30}$ is an arginine, lysine, glycine, histidine, cysteine, general formula 1, or general formula 2; $X_{G31}$ is —NH$_2$, glycine, threonine, serine, aspartic acid, glutamic acid, tryptophan, tyrosine, phenylalanine, histidine, arginine, lysine, cysteine, linking group, or spacer group, general formula 3, general formula 4, or linking group, or spacer group+$X_{G32}$, in which $X_{G32}$ is a lysine, cysteine, general formula 3, general formula 4, or absent;
the structure of general formula 1 is

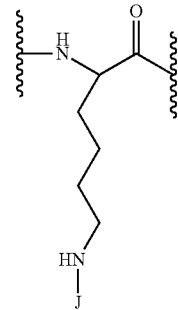

in which J is the structure of $L_n$-$M_L$ or a hydrogen atom;
$M_L$ is a modifying group including —W—X—Y—Z, a fatty acid, polyethylene glycol, albumin, IgG Fc, glycosyl;
$L_n$ is a selectable linking group, covalent linkage or absent; the selectable linking group includes polyethylene glycol, a long chain fatty acid, a polypeptide, a natural or non-natural amino acid, or a long chain formed by linking one or more of polyethylene glycol molecules, fatty acids, amino acid molecules through covalent bonds;
the structure of -W—X-Y—Z
wherein W is an α-amino acid residue having a carboxyl group in the side chain, this residue forms, with one of its carboxyl groups, an amide group together with the amino group at the end of $L_n$;
or W is a chain composed of two, three or four α-amino acids linked together via amide bonds, this chain is linked via an amide bond to the amino group at the end of $L_n$, the amino acid residues of W being selected from the group of amino acid residues having a neutral side chain and/or amino acid residues having a carboxyl group in the side chain so that W has at least one amino acid residue which has a carboxyl group in the side chain; or
or W is a covalent bond from X to the amino group at the end of $L_n$;
X is —CO—, —CH(COOH)CO—, —N(CH$_2$COOH) CH$_2$CO—, —N(CH$_2$COOH)CH$_2$CON—(CH$_2$COOH) CH$_2$CO—, —N(CH$_2$CH$_2$COOH)CH$_2$CH$_2$CO—, —NHCH(COOH)(CH$_2$)$_4$NHCO—, —N(CH$_2$CH$_2$COOH)CH$_2$CH$_2$CON(CH$_7$CH$_2$COOH) CH$_2$CH$_7$CO—, —N(CH$_7$CH$_2$COOH)CH$_2$CO— or —N—(CH$_2$COOH)CH$_2$CH$_2$CO—, wherein
a) the above-mentioned X forms an amide bond with an amino group in W through the bond of the underlined carbonyl C, when W is an amino acid residue or a series of amino acid residues, or b) the above-mentioned X forms an amide bond with the amino group at the end of $L_n$ through the bond of the underlined carbonyl C, when W is a covalent bond;

Y is —$(CH_2)_m$, wherein m is an integer from 6 to 32; and

Z is —COOH, —CO-Asp, —CO-Glu, —CO-Gly, —CO-Sar, —CH(COOH)$_2$, —N(CH$_2$COOH)$_2$—SO$_3$H, —PO$_3$H or absent, provided that Z is not —COOH when W is a covalent bond and X is —CO—;

the structure of general formula 2 is

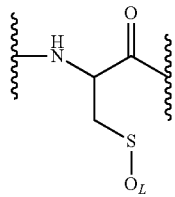

wherein $O_L$ is $M_r$-$L_r$-NH-J, $M_r$-$L_r$-$Z_1$, $M_r$-$L_r$-$M_L$, or a hydrogen atom;

J and $M_L$ are defined as the above;

$M_r$ is a functional group capable of reacting with the mercapto group to form a covalent linkage $L_r$ is an alternative linking group, covalent linkage, or absent, the alternative linking group includes polyethylene glycol, a long chain fatty acid, or a long chain formed by linking together one or more polyethylene glycol molecules and long chain fatty acid molecules through covalent bonds; $Z_1$ is —COOH, —CO-Asp, —CO-Glu, —CO-Gly, —CO-Sar, —CH(COOH)$_2$, —N(CH$_2$COOH)$_2$—SO$_3$H, —PO$_3$H or absent the structure of general formula 3 is

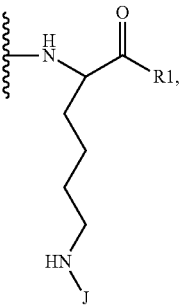

wherein J is defined above and $R_1$ is —OH or —NH$_2$;

the structure of general formula 4 is

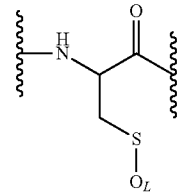

wherein $R_1$ and $O_L$ are defined as the above.

2. A protein conjugate, wherein said protein conjugate is a compound obtained through modifications including acylation, and grafting on the basis of the fusion protein of claim 1.

3. A pharmaceutical composition comprising the fusion protein of claim 1 or the protein conjugate thereof, as well as pharmaceutically acceptable carriers or additives.

4. The fusion protein of claim 1, wherein $L_j$ is a short peptide, the general formula of said short peptide is a (GlyGlyGlyGlySer)$_n$(SEQ ID NO:436), n is 0, 1, 2, 3, 4, 5, or 6.

5. The fusion protein of claim 4, wherein $X_{G1}$ is a histidine; $X_{G5}$ is a threonine; $X_{G6}$ is a phenylalanine; $X_{G25}$ is a tryptophan; $X_{IL0}$ is absent; $X_{IL66}$, $X_{IL69}$, and $X_{IL122}$ are a cysteine.

6. The fusion protein of claim 5, wherein $X_{G2}$ is a 2-methylalanine, glycine, D-serine, serine, threonine, or valine; $X_{G10}$ is a valine, tyrosine, lysine, arginine, cysteine, general formula 1, or general formula 2; $X_{G12}$ is a serine, isoleucine, or lysine; $X_{G16}$ is a glycine, serine, glutamic acid, or lysine; $X_{G17}$ is a glutamine, arginine, isoleucine, or glutamic acid; $X_{G18}$ is an alanine, arginine, or histidine; $X_{G20}$ is a lysine, arginine, glutamine, 2-methylalanine, general formula 1, or general formula 2; $X_{G21}$ is an aspartic acid, glutamic acid, or leucine; $X_{G24}$ is an alanine, glutamine, asparagine, or glutamic acid; $X_{G27}$ is a valine, leucine, or lysine; $X_{G28}$ is a lysine, arginine, alanine, aspartic acid, or asparagine; $X_{G29}$ is a glycine, glutamine, or threonine; $X_{G30}$ is an arginine, lysine, glycine, general formula 1, or general formula 2; $X_{G31}$ is a glycine, serine, lysine, or cysteine.

7. The fusion protein of claim 6, wherein $X_{G3}$ is a glutamic acid; $X_{G17}$ is a glutamine; $X_{G18}$ is an alanine; $X_{G21}$ is a glutamic acid; $X_{G24}$ is an alanine, or asparagine.

8. The fusion protein of claim 7, wherein $X_{G12}$ is a serine; $X_{G24}$ is an alanine; $X_{G27}$ is a valine; $X_{G29}$ is a glycine; $X_{G30}$ is an arginine; $X_{G31}$ is a glycine.

9. The fusion protein of claim 8, wherein $X_{G10}$ is a valine; $X_{G16}$ is a glutamic acid; $X_{G28}$ is a lysine.

10. The fusion protein of claim 9, wherein $X_{G2}$ is a glycine.

11. The fusion protein of claim 10, wherein $X_{IL84}$ is an asparagine.

12. The fusion protein of claim 10, wherein $X_{IL84}$ is a cysteine; $X_{IL116}$ is a serine.

* * * * *